United States Patent 8,178,339 (REDUCED GENOME E. COLI) - sequence listing, part 3

SEQ ID NO: 1 - DNA, 4639675 bp, Escherichia coli (residues 3,093,119-4,639,675 of 4,639,675)
aatgaacgatattgcgcataacctggcacaggtccgggacaaaatctcagcggctgcaacgcgttgcggccgttctccagaagaaattacgctgcttgcagtcagtaaaacaaaacctgcgagcgccatcgcagaagccattgatgccgggcagcgtcaatttggtgaaaactacgttcaggaaggggtagataaaattcgccactttcaggaactgggcgtaacaggattagaatggcattttattggcccgttgcagtctaataaaagccgcctggtggcagagcatttcgactggtgtcataccatcgaccgtttgcgcatcgctacccgtctcaacgaccagcgcccggcagaacttccccctcttaacgttctgattcaaattaacattagtgatgaaaacagtaagtccgggattcaactggctgaactggacgagctggcagctgcggtcgctgaactaccgcgtttacgtctgcgcgggttgatggcaatccctgcgcctgagtcagaatatgtaaggcagtttgaagttgcacgccaaatggctgtagcatttgccggactgaaaacgcgctacccgcatatcgacacgctctctctgggaatgtcggacgatatggaagccgccattgcggcaggtagcacgatggttcgtatcggcactgcaatttttggtgcgcgtgattactctaaaaaataaggaattaaaggaacgccatgaatacgttgactttcctgctttcaacggtcattgagctgtataccatggtgctgttattacgcatctggatgcagtgggctcattgtgatttttacaaccccttctcacagtttgtagtgaaggtaacgcagccaattatcgggccactgcgccgcgttattccggcaatggggccaattgacagcgcctcgctgctggttgcctatattctcagttttatcaaagccatcgtgctgtttaaagtggtgaccttcctgccaatcatctggattgccggtttactgattctgctgaaaaccatcggcctgctgattttctgggtcctgctggtgatggcgattatgagctgggtaagccaggggcgtagcccgattgaatacgtgctgattcagctggccgatccgctgctgcgcccgattcgccgcctgctaccggcaatgggtgggattgatttctcgccgatgatcctcgttctgctgctgtatgtcatcaatatgggtgtcgcagaagtattacaggcaaccggaaatatgctgctgccagggctgtggatggcgttatgaatgccgtaacagttaatgatgacggtctggttttacggctctatattcagccgaaagccagccgtgattctattgtcggtttacatggcgacgaagttaaagtcgccattaccgcgccgccggttgacggccaggccaacagtcatctggtgaagtttctcggtaagcaattccgggttgccaaaagccaggtggtgattgaaaaaggcgaacttggccgccacaaacaaattaaaatcattaatccgcaacaaatcccgccagaaatcgcggcgttaattaattaggtatcctatgcaaaaagttgtcctcgcaaccggcaatgtcggtaaagtgcgtgagctggcgtcgctgcttagcgacttcggtcttgatatcgtggcccaaacagacctcggcgttgattccgctgaagaaaccggcctgacctttatcgaaaacgcgattctgaaagcgcgccatgcggcaaaagtgaccgctttaccggcaattgccgacgactctggtctggcggtagatgtgcttggcggcgcgccgggcatttactccgcgcgttattccggtgaagacgcgaccgatcaaaagaatctgcaaaaactgctggaaacaatgaaagacgtaccggacgaccaacgtcaggcgcgtttccactgcgtgctggtatatctgcgtcacgcggaagatcccactccgctggtatgccacggtagctggccgggcgtgattactcgtgaaccagcgggcactggtggctttggttatgatccaatcttcttcgtaccttccgaagggaaaaccgccgccgaactgacccgcgaagaaaagagcgccatttcccaccgtggtcaggcgttgaaactgctgctggacgctttacgtaatggttaaattacctccgctgagtctctacattcacatcccgtggtgcgtgcagaaatgcccgtactgcgatttcaactctcacgcgttgaaaggagaagtgccgcacgacgattatgttcagcatctgcttaacgatctggacaacgatgtggcttacgctcagggccgtgaagtaaagacaatctttattggcggtggtacgccgagcctgctttccggcccggcgatgcaaacgctgctggacggcgtgcgtgcgcgtttgccgctggcagcggatgcagaaattactatggaagcgaaccctggcacggtagaagccgatcgctttgtcgattatcagcgtgctggtgtgaaccgcatctctattggtgtgcagagttttagcgaagaaaagctgaaacgacttgggcgtattcatggcccgcaagaagcgaaacgcgcggcgaagctggcgagcggtttagggttacgtagctttaaccttgatttgatgcatgggctgccggatcaatcactggaagaggcgcttggcgatctacgccaggccattgaactgaatccgccgcatctttcctggtatcaactgaccatcgaacccaatacgctgtttggttcgcgaccaccggtgctgccggacgatgacgcgttgtgggatatattcgaacaggggcatcagttattaaccgcagcgggttatcagcaatatgaaacttccgcttacgccaaacccggttatcagtgccagcacaatctcaactactggcgctttggtgactacatcggtattggctgcggcgcacacggcaaagtgaccttcccggatgggcgcattctgcgtaccaccaaaacgcgtcatccgcgtggttttatgcaaggaaggtatctggaaagccagcgtgatgtcgaagccacagataagccgtttgagttctttatgaatcgcttccgtctgctggaggccgcgccgcgcgtggagtttattgcgtataccgggctttgcgaagatgtgattcgcccacagttagacgaggcgattgcccagggttatctcaccgaatgtgcggattactggcagataacggaacatgggaagctgtttttaaattcgctgctggagctttttctggctgagtaaacttgtattgccggatgcggcgtgaacgccttatccagccgacatgtggcagcggttgtaggtctgataagacgcgcaagcgtcgcatcagacgttgattgccggatgcggggtcaacgccgcatcctgctacaaatcgtgcactatatcaaacttacttaatcaccccattgcgccgcagttgttcggtatcttttttccagcgttcattagcttggttgatatcgtcaattttcatcaaaatcgcgacttttttactgtttatttctgaaactttcatcgttaacggatattgccctttttcgagcgttacccagtcatcctgcaatttacggctaagtttttgtgattgcagaaaagtctgtcgccgttgttcgttgatatcgaaatctcgtttctgctgaatcggcacttcataacactcttcactctgtttatgacatgccgcaatcgccggttgataaacctctttgtcatatttaaccgcgaacgcctcgctatcgttctgtttattaaactcatcacgctgttggtgaatttttttaaaggcgtcttcgcgggtcatttgcttaccgtttgcatcttttccccaatatgcatccgctgctttctgcgccgccaccatttgcttatcaagcgctttcacttccttttccagcgcaggaatcgagttcttctgggtattcaacgcagattcaagctgactaaagcgataattgaaatcttcgctattcacgatcagatatttattattcgttttgatatcgtcgaccacccgcccacgatcgctggctgccgcctgaaaagagtaaaagttcaccgaccagccagacgcgggcgttcctttactggttaacatcgccgagaattttaccggtttatctttcgtccaggtctgttcgagcagttcgtaatctgccaactgaccgacccaggtatagagatcgtcactggaagagacatcgccttccgctgaccaggtggcctgattacccttagcatcaagattttttaaggtgatagcatcaagcttgagaatgccgtgatactgctttttgaattgatcttttaagatattttcagttggcggttcgccatctgcccaggcattaccagtcatcaacataagcagtgccgtgccaacaatccattgctttttcacccgaaaaacctcacgcggaataatttattccggtgattatcattagggtaattaaaattggcaatggacgtgagtctgaagtgaaaaagccccggcacgataccggggcgaggcgattagtactgattgaagatctgctggatctgctgcggatctttggtttgcgtcagagccagttgcagcagaacgcgcgctttttgcgggttcagcgtgccagaggcgacgaagccgtatttcgcatcatccacttcggcatcctgagtggtagcgcccgtcggtacgcgggaagaacgcacgactgcagtaccggttttcgcggcggtcgccagcgtgtcgaacacagatttatacaggttgccgttacccacaccagcgctaacgatgccatcatagcccgcatctaccagtgctttagccggaagatcggatgcgttagcgtagttataaacaatgccgactttcggcagttcattcagcttagagacatcgaatggcgtgtcgctggtatgcttacgtgccggggtacgctggtagtcaatcttaccgttgtgaatgtaacccagaggaccgtagttaacagacttgaaggtcgctacgtcggtggtgttggttttggtgacgtcacggccatcaagcacggtgtcattcatcactaccagcacgccacggttggcggaggctttatcagctgcggtcactaccgcgttatacaggttgaatggaccgtctgcgctcatagacgtggacggacgcattgcgccgaccatcaccaccggtttgtcgcatttcaccgtcaggtcgaggaagtaagcagtttcttccatcgtgtcggtaccgtgggtaatgacgaagccgtcggtcttatcgcagtcggtgttaatttttttcgccagtgtcagccagacattatcgttcatgtcctgggagccgatattcactacctgctcgcctttaacgttcgcaatgtcttttagttgcggcaccgcattaaccagattttctacgccaactttacccactgtgtagttagatttggttgcggagtcaccaccaccggcaatggtcccgccggttgctaaaatggtgatattgggtaatgccaatgctgcaccactaaaacccataaccagtgcggcaagtgccgtctttttgaaaaactccatttcattcctccagttacgtgaacgctacgcattatcccttagctctgtatgggaaatttgacgttaaacaatttacaacgtgaatatattttggagatctacaaagttagaggcaggtaacaaaacgaagaattaaacggcataaaaaagtattatgccgtcttaaaatagaggattattttaaattcccgaccagggctttgcggctatcttccagagtcacaacgcggctacaaacatctttgccaaactgctggaaatctttttcctgctttttccactcggtttggattgaggattgcagcccccccaggcttcccagcacattctgtaatgggttaccgccgcttttcagcaccgctttcgcgcccatttcattaatgctgtcctgtaaaattccacccattgcctgattcactaattgctggccttcggcgcgaacctgatcaatggctttatagtgaaacgtcaggccatcgctgcgcgtttcaataatgcggttcatctgctctttcagctgcgcatcaagtttggtcagacggctgcgcattttgctgctttcgcccatctcctgaacgataattttatccagagcaatacgggctttctcgacgcggcttttcgcgccttcatcaatccacggcagcgtgctgcgtagttcagcctgataatccttcgcctgctcgcgctgggcggcattcagggaatattgcttaccgttatacatcacgttgccgtctggcgtgatcaccagattgccgttttcgcccttcacctgcacggtttgcgggctgacaatcacatcgtcacgcggcgtgacgctgcactggtagtcggcgtgagcggtcattgccgtcactgaaagtgctgccgccagcagcattttgcgcatcatagtcttccctcaagaaaaaatcaggccagcatttgctggccccagattgataacaaagtacgcgttttccatgccggatgcggcgtaaacaccttatcccgcctactcgatcgtgcatctttccaggcctgataagcgtagcgcatcaggcagttttgcatttgtcatcgcccgtatgctttcttagtcccaccaaacgtcgaaaagttcgctggtgcgtacctcatccagtttgcgctcttccagccacttacgcacaatcgcctgatgttcttcggtgcatttgccgatttcctgcatgcagatcagaccttcccaggccagataaccgctgccgtcaaaggccagtttgttcggttcgataacctcgttaataaaatcatcaacggttttatcaatctgttcttccgatgtaccttccgggaatcgccatgccaccgaaaatcctaattcctggaattcgtcgatgtgcatttttttacgcagacgacggctacggttctttgccattatttcaccctctcgaacattaagtcccatactccgtgaccaagacgatgaccacgttgttcaaatttcgtcaccggacgtgatgccggacgcggtacgtaatcattgctctctgacaggtttttataaccgtcaatagaagacatcacttcaagcatatgttccgcataaggttcccagtcggtcgccatatggaatacgccccccagctgcagtttgctttttaccagttcggcaaacggcacctgaacgatacggcgtttattatggcgcgctttgtgccacgggtcagggaaaaagagctgcaccatgcgcaatgaattgtcaggaatcattttatgcagcacttcaaccgcatcgtgacacatcacgcgcaggttgcttaaaccttcttcatgcgcagaagccaggcacgcaccaacgcccggtgaatgcacttcaatgccgaggaagtcctgctcagggcgatctttagccattgccaccagcgacgcccccatgccaaaaccaatctcaagcgtcaccggcgcttcacggccaaaaagcgcggggaaatccagcatatcttcgctgaactcaacgcccatcaccggccagtagttttccagcgcatgttcctggcctttggtcagtcgcccctggcggcgcacaaaactacggatacggcgcagtgggcggccgttttcatcaaattccggtgaaatgacgtcgtttttcataaaggtttagtcgcttgtgaaagtgttctgaaaacgggcattatccaaagttagttgccggatgcaagcatgataaggccgtggctgcggaaagttccggtttacaccctgccgtcgctgtgctgcaatcttgcccccaacaacagtgaattcggtgaccatgcaagcgtcgcaattttcagcccaggttctggactggtacgataaatacgggcgaaaaactctgccctggcaaattgacaagacgccctacaaagtatggctctcagaagtgatgttgcaacaaactcaggttgcgaccgttatcccctattttgaacgctttatggcgcgcttcccgacggtgaccgatctcgccaatgcgccgctcgacgaagttctccacttgtggaccgggcttggctattacgcccgcgcgcgcaatctgcataaagcggcacaacaagtggcgaccttacacggcggtaaattcccggaaacctttgaggaagttgcagcactgccgggcgtcgggcgttccaccgcaggcgcgattctctcgctttctctgggtaagcactttccgattctcgacggtaacgtcaaacgcgtgctggcgcgctgctatgctgtaagcggctggcctgggaaaaaagaggtcgagaataaattatggagtttgagcgagcaggtgacgcccgcggttggcgtggaacggtttaatcaggcgatgatggatttgggtgcgatgatttgtacgcgctcgaaaccgaaatgttcgctctgtccgctacaaaacggatgtattgccgccgccaacaatagctgggcgctttatccgggcaaaaaaccgaaacagacgctgccggagcgcaccggctactttttgctattacagcacgaagatgaagtattgctggcgcagcgtccgccgagcggattgtggggcggtttatactgtttcccgcagtttgccgacgaagaaagtttgcggcagtggctggcgcaacggcagattgctgccgataacctgacgcaactgaccgcgtttcggcataccttcagccatttccacttagatattgtgcctatgtggcttcccgtgtcgtcattcaccggctgcatggatgaaggcaatgcgctctggtataacttagcgcaaccgccgtcagttggcctagcggctcccgtggagcgtttgttacagcagttacgcactggcgcgccggtttagcgcgtgagtcgataaagaggatgatttatgagcagaacgattttttgtactttcctgcaacgtgaagcagaaggtcaggattttcagctgtaccccggcgagctgggaaaacgcatctataacgagatctccaaagaagcctgggcgcagtggcagcacaagcaaaccatgctgattaatgaaaagaaactcaacatgatgaatgccgagcaccgcaagctgcttgagcaggagatggtcaacttcctgttcgagggtaaagaggtgcatatcgagggctatacgccggaagataaaaaataaaaacagtgccggagcacgcctccggcaacttgcataaaaacaaacacaacacgcacccggaatgatgaaaaaatatctcgcgctggctttgattgcgccgttgctcatctcctgttcgacgaccaaaaaaggcgatacctataacgaagcctgggtcaaagataccaacggttttgatattctgatggggcaatttgcccacaatattgagaacatctggggcttcaaagaggtggtgatcgctggtcctaaggactacgtgaaatacaccgatcaatatcagacccgcagccacatcaacttcgatgacggtacgattactatcgaaaccatcgccgggacagaacctgccgcgcatttgcgccgggcaattatcaaaacgttattgatgggtgacgatccgagttcggtcgatctctattccgacgttgatgatattacgatttcgaaagaacctttcctttacggtcaggtggtggacaacaccgggcagccgattcgctgggaaggtcgcgcaagcaacttcgcggattatctgctgaaaaaccgtctgaagagccgcagcaacgggctgcgtatcatctacagcgtcaccattaacatggtgccgaaccaccttgataaacgtgcgcacaaatatctcggcatggtccgccaggcgtcacggaaatatggcgttgatgagtcgctgattctggcaattatgcagaccgaatcttcctttaacccgtatgcggtcagccgttccgatgcgctgggattaatgcaggtggtacaacatactgccgggaaagatgtgttccgctcgcaggggaaatccggcacgccgagccgcagtttcttgtttgatcctgccagcaatattgataccggcaccgcgtatctggcgatgctgaacaatgtttatctcggcggaattgataacccaacatcgcggcgttatgccgtcatcaccgcctataacggcggcgcaggcagcgtgctgcgagtcttttcgaatgataagattcaggctgccaatattattaacaccatgacgccgggcgatgtttatcagacgctgacgacccgccatccctctgcggaatctcgccgttatctttataaagtgaataccgcgcaaaaatcctaccgccgccgataattccattaaccgcccctgacgatgctcaggggcaaaaatgttatccacatcacaatttcgttttgcaaattgggaatgtttgcaattatttgccacaggtaacaaaaaaccagtccgcgaagttgatagaatcccatcatctcgcacggtcaaatgtgctttttcaaacactcatccgcatcacgatgtgaggaaattaacatgaatcttaagctgcagctgaaaatcctctcttttctgcagttctgtctgtggggaagttggctgacgaccctcggctcctatatgtttgttaccctgaagtttgacggtgcttctattggcgcagtttatagctcactgggtatcgcagcggtctttatgcctgcgctgctggggattgtggccgacaaatggttaagtgcgaaatgggtatatgccatttgccacaccattggcgctatcacgctgttcatggcggcacaggtcacgacaccggaagcgatgttccttgtgatattgattaactcgtttgcttatatgccaacgcttgggttaatcaacaccatctcttactatcgcctgcaaaatgccgggatggatatcgttactgacttcccgccaatccgtatctggggcaccatcggctttatcatggcaatgtgggtggtgagcctgtctggcttcgaattaagccacatgcagctgtatattggcgcagcactttccgccattctggttctgtttaccctgactctgccgcatattccggttgctaaacagcaagcgaatcagagctggacaaccctgctgggcctcgatgcattcgcgctgtttaaaaacaagcgtatggcaatcttctttatcttctcaatgctgctgggcgcggaactgcagattaccaacatgttcggtaataccttcctgcacagcttcgacaaagatccgatgtttgccagcagctttattgtgcagcatgcgtcaatcatcatgtcgatttcgcagatctctgaaaccctgttcattctgaccatcccgttcttcttaagccgctacggtattaagaacgtaatgatgatcagtattgtggcgtggatcctgcgttttgcgctgtttgcttacggcgacccgactccgttcggtactgtactgctggtactgtcgatgatcgtttacggttgcgcattcgacttcttcaacatctctggttcggtgtttgtcgaaaaagaagttagcccggcaattcgcgccagtgcacaagggatgttcctgatgatgactaacggcttcggctgtatcctcggcggcatcgtgagcggtaaagttgttgagatgtacacccaaaacggcattaccgactggcagaccgtatggttgattttcgctggttactccgtggttctggccttcgcgttcatggcgatgttcaaatataaacacgttcgtgtcccgacaggcacacagacggttagccactaattacgcaaagaaaaacgggtcgccagaaggtgacccgttttttttattcttacttcaacacataaccgtacaaccgtttcacgccatccgcatcggtttcgctataaacaccttgcagctccggcgaaaatcccggcaacaaattcaccccttcttccagtgcaaggaaataacgttgaaccgccccaccccagacttccccgggtaccacgcaaagcacgccaggtggataaggcaacgccccttctgccgcaattcgcccttcggcatcacgaatccgcaccaactccacgtcaccgcgaatataagcgctatgcgcatcctgggggttcatcaccactgacgggaaactctgctggcggaacatcgctttttgtaggtctttgacgtcgaaactgacatacagatcgtgcatctcctgacacaactggcgcagggtgtagtcgcgatagcgcaccggatacttgttataaacgctcggcaacacctcaaccagcggcgagtcatcctcaatatgctgttcaaattgcgccagcatcgccaccagttgtgccagcttctcgtggctttccgccggagttaataaaaacagaatggagttgagatcgcacttctccggcacaatgccgttctcacgcagatagtgcgccagaatcgtcgccggaacgccaaagtcgctatattcgccggtttcggcatcgatacctggtgtagtgagtaacagcttgcacggatcaacaaaatactgatccgcggcatatccttcaaagccgtgccacttcgcccccggctcaaaactgaaaaaacggcggtcgctggctaacactgatgtcggataatcctgccacaatttgccatcaacaacgggcgggataaacgggcggaacagcttacagcgcgcaagaatagccttgcgcgcttcaatccctatctcaacacactcagcccacagccgacgcccactctccccttcatgaattttggcgttaacatccagtgcagcaaacagcggatagaaagggctggtagaagcatggagcataaaggcgttattcaaccgcttatgcgggcaaaaacgcgcctgtccgcggatatggttatcttttttatggatctgcgacgtctgtgagaatcccgcctgctgtttgtgcaccgactgagtcacaaagatccccggatcgttttcgttaagttctaacagcagcggcgagctatccgccatcatcgggataaattgttcataaccgacccacgcggaatcaaacagaatgtaatcacacagatgcccaacggtatcgatcacctgacgggcgttatagacagtgccgtcataggttcccagctgaataatcgccaggcgatacgggcgcggcaggtcggctttttctggcgcaacgtcgcgaatttgctggcgcagatactcttcattaaaacagtgcgcatcaataccgccaatgaaaccaaacgggttgcgtgaagcttccagatagaccggcgtcgcccccgcctgaatcagcgcgccgtgatgattcgacttatggttgttacggtcgaagagcaccagatcgccacgcgttaacagcgcattcgtcaccactttattcgctgccgatgtgccgttcagcacaaaataggttttatcggcatgaaagactttggctgcgaatttctgcgcatctttcgccgatccttcatgaataagcagatcgcccaattttacgtcagcgttacacatatcggcgcgaaagacgttctcaccaaagaaatcgtaaaaatggcgtccggcaggatgctttttaaaaaacgcaccatgttgatgtccagggcaagcaaaggtgctgttgcccatctcaacgtactgcgtcagcgtgtcataaaacggtggcagcaaattctcttcatactgacaggctgcggattccagctccagccactgctgctcgttgccgttgattaccgccgtaacgcccgcaggtaattcaacagcatgttcggaatacaaaaacaccggtagatgaaaaccggtgcgcttaagcaacgcaagaatgccactgcgactatccgcagcggtaatgacgactgccgcgacgtccgtaaaatcagtatctcccaacgccaccacgcgacgatgagaagaaagtcgggataccagttcactactggcggcaatattcattgatttcataagcgcaaacccgtttcggggaagtaagaataccggacaaggtggaaaaccctgccccatgagatatgggtcaaactggtcaccagctccgaccgccagacatcagtaaaagcagaaacgctctgattttactgttgtcctgcagtgagcgtgcgttaacttcaccgcatgagcagtaacatagaaagggaaacgtttcgcgcgaaacggcgataagcgagagaatgtaaggagatggcgtgcatcgggcaaactccgtacagagaggagaaaattcgcgcaatcatggcacctttcgctaaagcgtgcaagccaggactttgcgaacaaacaagccatcgacggcaccaaacggtcataataagaaaatcaaacaatacagctaacaggaactcttgtggtcatcggcccttttatcaacgctagtgcagtcttactgggtggcgttctcggcgcactgctcagccaacgcttaccggaacgtatccgcgtctccatgacatcaatttttggtctggcatcgctggggattggtattttactggtggtgaaatgtgccaaccttccagcgatggttttagctacgctacttggcgctctaattggcgaaatttgtttgctggagaaaggtgtcaatacagcagtcgccaaagcacaaaatctgtttcgtcactcacgtaagaagccagcgcatgaatcttttattcagaattatgtcgcgattattgtcctgttttgcgccagcggcaccgggatcttcggggcgatgaacgaagggatgaccggcgatccgagtattttaatcgccaagtcatttcttgatttctttacggcgatgatcttcgcctgctcgctgggtattgcggtatcggtgattagtatcccattactgatcatccagttaacgctggcgtgggctgccgcgctgattttaccgctgaccacaccgtcgatgatggcagacttcagcgccgtaggcggtttattgctgctggcaaccggattacgcatctgtggcattaaaatgttcccggtggtcaacatgcttccagcactccttctggcaatgccgctttccgccgcctggaccgcctggtttgcctgacaatgcgtgcaatatcggcaaagtgatgatagattgtgcagtctgcagtaaattgaagaaatttgattgacgagacgaggcgaatcaggtttaatgcgccccgttgcccggatagctcagtcggtagagcaggggattgaaaatccccgtgtccttggttcgattccgagtccgggcaccactaattcttaagaacccgcccacaaggcgggtttttgcttttggatctgacaataaccttcacgaaaaaaattagcttataaagtctgggggaattactctcgccacgttaacgagagtaattttattgatattaatctcctgatactttacccccgtccaaactccagccgctgcacattcaccatcccaggcttctcagcagcactgacatcaatttgtgtcacccgcagcgcatatttttcatccagtgcgtttaaccatttcagcaggtcattaaacaccacaggttctatccagacctgaatattctccccacgatcggctatccgcctgatgaccaccgagtgcgcggaagcactgtcactgatgacccgcgatacctgcgcaggcgttgttgtggcagattttcgcgctgcaataatatccggcgcggcgttcttcagtcgggtgttcatcgccaccagctgctgcaatattgtctcctgttgctcaatccgttcgctcaacggctgccagatgaggacgtaatatccgacgctaaacaggaacaccaccgctgccagtaacatgcccttttcacgcggagaacgccccgccaggtgttgtgccagccagtgttcgccacggcttaactggcgttcacgccattgctgaaaatagtgaataaatttatcgcgtaacatgttatttcctccgcaacgttacgccgccggaaaccgcatcaccctctttctgtaacgcgtcctgttgcacaacataatcggttgccagtacactacgcagtttgtcgaaactggcaaagttcgcggcccgtagctggaggtgaagtatctggcgtttttgatcaaaggtaaaaccacgcatttcgatgtcggaaagtgacgctgatttcagggtgctggctatcgctgacaactcggcgagcagccgggtatcgtcggcctgtgggcgatattttttcagcgccatcgtcacctgagagcgtaaattcacaatccgcttctgctccgggaacaacgttaagaactgttcctccgcctgggtgcggctttgcgccacctgttcgctgacgctccataacgtcacgccccgctccactgccagcgcaaccagaatcagcaatatcggcagaatcatcacccgccagcgcgcccactgttttcggtagctgacgcgaggctgccacggccctgtcagcaggttcccttccggttcgccataagtggtaatggcgggcagagctgtaacggtcaggcgttcagcgtctgcgccagcccatgctgatagcttttccggtgcaatgccgactacggttagcgaaagcggtaaatcctgctcattgagctgggcgcggaacatgaccggagccagcgccagcccggcgctccatccccggcattcatcgatgcggcagataacccgttgcgcatcgcaagccataaacccacaaggaatggacatccagtccggcgcgacggtagcgcgggtgatgccgttttcctgcaaccactgcgcaatgttgcgcatatgctgttggtgaatcactgctacggttgccagttgctggtcgatattcaacggggcgaaatgcagttcatcgatatcctggttcagctcttcttccagtaaggcgggcagaatagtcggtagcgcagcgcgatggaaatgtcgtggcgcgcacccttgcgtaaaaccgtaagttgaatggaatccattgaaggtaactgccgcatcagagcaatcattgctcgtggatcagtgaaatcctgctgatttagcgcaatggcgatatcgccttccttgaaaccgctggcatcgaacagagaacgatctgcccccggcttcgctgcataaccgacaatcccctccttacgcacaggcgtaagctggatatagttaaaaattttctgcggatctttcgccagtgcctgacgcacggcagccgggatctcaactggcacactgacagcaggctcagcaacagcttgctttgcttcgtcactgacggcttttttgttggtcacagcaacagtggaacgttcctcttctgccagactcagacgctctatttttccctgataacgcagcatcacatggtcgcggttgatttcctcaatcaccgcgttgtgagagccaagcgtttcaccctgcaaatagacctgctgtttaccgccttcttcaataaccgcgccgggtctggcaccaaaggcgatcccacgcagcaccacattaagacgcgtttctgccacaggcacaggttcgggttgttttacctgcgcggcgacaggctgatatttgccaaaccagttttgctggctgattaattgcacgtcatttttatcgaacgtttttgcatccacacggctcggtttattcaccggttgagaaaccgccgtatattccgcagaaaaggagatatagcgccagagtgaatgcgccatttttgcagaaataataagcagcatcagccagaacatcccgcgtgcaatttttcgcagatgctctttgtctgtattaagagattgtctctggttaagagtgtgacgaatttttgtcagccattgaatgagataaattcgtgcgtcacgaaaaacaacccgcgccaatttatatctacccgacgttatgctttgactattccacaggtggtacgatccagtttccgctgatactggttacctgtacgtgtatcattaatcgttatgctgtaattaattccctcagtgatcattaatttcaccgtcgggtcagcgcacatttgtcgttgatagctggttaaaaaggcgtcaggcgtctgcgtggtttgtgtacccgcttcgctgataatggtcatttttaccgttgtgccgctactttgcgccagcactaaggtatatcccgcagatttaatcggcaggttttggctgatattttgcgcctgttttttcgccagtaaactggcattttcattatggctggcacagccacttaataatcctgtaacgctcaacaatagcgatattaataccctccctggcatttgttttatcgacatggtaaataatctctaaggttattaataagagttaaaatgtcactttgataatgacgtggttatcattaaaacaatgcctgtagataaagtgttgctataccgcccagacttaaacacggtccaaaaggcagtgtggttgatcctctttttgtaataacggcatatatcaggccgcagcatgaggcgattaaagcaacattgggcagcgacaatgcccccacccagccacctaacgcggcgaaaagtaatacatcgcccatgcctaatgcttctttacgcagaactattccggctatccaacgcagagagtaaaaagtgataaatcccaccaggacgccggtgactgcatcttgtagcgtgagcggactctgctgcgcccatgccgcaatcagtcctgtccacaatacgccctgagtaaaaacatcgggcagccattggtgatcgaggtcgatgacactcgcggcaatcagccaggcggataatatcatcaccgccagcccccatccactttctggccagaccagactcgccagcaaaaaagcaagtgctgtcaataactccaccagcggataacgcttgctgattttcgcctgacagtcgcggcagcgccctttgagcatcagccaggagaacagcggaatattgtcacgtatccggatggtctgctgacaatgtgggcagtgcgaacgcggtagcgcaaggcttatttttgactgcgcactcgacatttcaccgtgaaactccgccatttgttggcgcagcatgattgggtaacgccaaatcaccacattcaaaaaactgccgatgatcaatcctccgacggttgccaggacgggcatcgccgtggggtattgctgaaaaacatcaaaaagcatggttaaaggttgtttgttgtaacttgctggatgcggcgtaaaacgccttatccgtcctacgggtgtctgccagcgcaaataatcgcggctttccccgtctgtaggcccgataagcaggcgcatcgggcaaatgtgttaacccggtgcgccttatttcatgccggatgcggcgcgagcgccttatccggcctacgggcttactcggcagacatcttatgctcggtaacctgattaatggtttccggtccctgttccggtttcggcagatcgagtgacgcgagcgtgttgtaagccgactggctcacaccgccctcgaagctcatctcgctcgcccccggcagctggtaagcattcgcgcccggattccatttcttaaagaactccgaaagatccgtctgggcgacccaggaggcacacagcatcagcgtgtccgctgcgttaccgttggattcagcacagtaattcttgccgccaaacttgtcattgctgacctcatcgccgcgtgctttacgatgcatcaactggaacaggttccagcctttcatcccttcacgctcgctgtaaaactctggcagaggagtgccatctggataccatttcttgatatcaaagtttttctctgcccattccttcagctgtgcgtacatcagcagacggtcacccgcaccgccgcgtgcccatgcctggttgttgctctcctccagatattccggtgcgacggtaatatcgtcagcgacacggttcatcttgccgagataacgatcctgcatgtacagcgccagcacgttgttagcgacttcagttgcacccggtacagtcaacggcgtttctgcggcgttatgaccgacttcatgccagatcagccagtcgttcagcggcgtcgtcggcagcgtggtgctgttcggcgagaagctgctgttcattaccggataacccgaatgcgcatcaccgatggagatctgcacatcgttggtgaaacgatgtttgtggcccggcaagtttttataggtaaacatccggtgcttaccgtcttcgctatcacggccgtagaagtcattcatcgagctggcaaaggtatccagatcgttagcgaattgctccagtccgccagtgtaattgctggcattcaggttcttcttcggtgtggtatagacgaaagcgtctgattccagctcacccagcggagccggtgagttcagatcgtttttccatgcgccgtctttatagaacggtgcttttaccacgccagtaaaggtgaagctggcagattcattggtagagctattgcccttgatataaatcaggccaccgtaaggcaccttgaacttcaccgtaccgctagcgtccagagagtacgttttagtcactcttggcggacggttcagcgcaacttcatgcttctcacgtccggtcaggtcgtcagccagcgccacggtgacggtcacaggaacgttcgcattggacttaatggtgacctctttctgagccggtgcccacaggccagttgactgcatgttacctgcaaaccatttggtcggattcgagtacaggctgatggtttcagtaacgttctgtccctcttccgatactgctcccggatacttctcgacatcaactttgatgttcagatcccaccaggaacggcccagcatcaggcgtgtcagcggtttttccatatagttgagcgggtagctcgggttcatcatgcccgctttgctgctaccgtcaccgtagatcatgttgttatcgaccagcgattttttcagatctgcagaacacttggtgccgcctgcataggcatcattggcgtagcagttcaggaactcggtgaacgttttaaagcccagctcgtcatttttgccttcttcataacgatagctcgtatcgttccacagccagaccgacatgttctggtacagacgttccagatcgacgctgctcagacgctcacctttgcgaccattggtccggaagtagagctcatgctgatacagacgctgaatgttggtgcctaaatccgcagcctgcaccatcgcttttgcagtgtcggcgttaaggcttagttgcgtatactgtggaacatacatgccaccagtaaccggaacccccgtgccaggacgatattccaggcagttgacctcatagtgatatgccggattagtacactctttcagccccgggaacgcggcgaaaattttctccttcgcagccttcagagaatcctctgttttatgatcggcctcatcaataaaggcataacgcgtttcctgtttgccatctacatcttccagccagctggcaacttccagcttcggtttgtcatcaggtttgttttctacctgatatttccacttaacttcccctgtcttactatcgatggtgtacggcagcgcaccatctacggcaggataacgttcatagacccaaatgcccgttgcgcgctgctgacgaacgcggttcggatacccttgcggatcgttatttactaccgacttgttcagtgccatcgacagacctgcggcatccaacagacgcacaaaaccagacgcgctctcttccttaagattgctcatcacgttttccatgatcagcaccgatccacctttgttcagataggcgatcagatcggtcacatcctgctgagtcagcttcggtttgctggtatctgcacgcagcgggattgcataaggatcgttacccacctgagtcacatattcaaagccgttaaggatcagcagcggcatttcctgcggatcgagatcgccatagctacttaaatgctcaacagagatgcccgcaaaatccggatggaagtcgaacgcagcgctgtttcctgtaacctgaccatgacgtttaaaatagacagtatccaggttggtgcctacggtcatgctggctttcgcgtccggcttccatttatcgtcggacagatagcgcagcacgttctccatgaagttcttcatgtcatccgggtcgctgttgagcgtacactgcccatctttattaacgcccccgttccagctgtaaccgttcgggcaacgcaaaatgctgttgtagtgtgggttaccgataaccatcagtttgccctcaccgacttgccccagcgaaataaacggcaggttaaaggtggcggtatcgcgcgtaacgttttccggctcaacaagagaaggcgcttccgtaatgtacgccagctcgtttttatcccaggcgcgtttttcgccgaaggccagccagtagtttttatcattacgcgccatcagaatcgggaaggccgcgttggagatattcaccaccgcctgaccgcgcgcattacccgtgctgccatagaagttggtggagtcatggaatacatggaacttgctgacagatttgtagttcgtatccacgccccacagcttgttgataacgccctgaatctggccgtcattaacattgcgcgtcgtcagcgagaaccagcgagcctcgttacaaccatcggttttcgcacaaatcgcggtatcgatctctttggcctgacccgtattaaactgctcaataaattcgttaggcagattaacgacttgctcaccttcccccagcgtcgcaccgttggataacgagagattgataatctcgttgatcacgttgggatattcggcaaagaccttgcgtacatcgtccggaacaacacgggtattattttgcccggtcgtcgaatagcgatgaataagctgatcaatattcgccccgcgaacttcatcacccagttcagtcagcgcaatggtcgacttattgccgcgcactgaacccagttcaaaggtatcgataccaaaggagatggtttcgccccagctaaaggaaaattcaccattttcccctgtcacgccacggcctgaattggtgtagtagttgacgccagcaacaccatatccctggctatcgaccagtcgaccttcagagagaatgatttcagtgggttgatactgataaaactgttccgcgttagccgacacgaaggaagcgttcagatccggttttgttcccggcgtggtgacgggcacgaccggtgaagtatgagtggatggcgctttatcggtcgcagcattgttttccacctcttcattgaccagctttttgaactcttccggtgccagatcgatttgcttatacagcgagtcgaagcgtttactctcgatcaccgaggagaacgtcagacaaacctgttctgtattcgccggacagctgttactggacgttaccagcgaaaccgcattgcttttcttgtcatcggagcccgccagttcttgcgcgtcctcaaggctaaacgacactttttcaaccgcacgcaagctacgcgcagcttctgactgagtgttgaaggtggcaattgtcgtgttacccgccacgcaagtaacgtcctcgccaggtttaaatgtaaagccatcgctggattcaccattacaggtagcaccagttacccgctggcttccgcccagggtcagataacccgttttcgtaggaacaggttctggctccggttctggtgttggttcaggatcaggtatcggttctggcgtaggctctgggtccggcgttggctcaggcgtcggctccgggtttggtgttggatcaggtttcacttccggcaaagaccctgttccagaatctacaggcggcgtatcggaggaagatccggaaccaccgccatcacaaccggctaacagggttgcgctcaaaatagccgctaaaagcgatttcttatatttaaatttcttattcattaataacgcaagtgacaaaacaatgttaaaaaattcgtaactgggagaaatagttttatgctttatcttctctaataacttcctccattcttaagaaaacgacatcattgatagaaaacaggtgaaatttataagaataacccctatacgatgtctatctggctatttttacgaaatttcaacaaacaaaaaattaacaacatttcacaacgtaactatataaatttgttggtagttttaacgattaagattgcaaaagcaacagatagaacggtgtttgctcatcaagcgaacataattaatacagacttgttttgcgtgataaaaaaatagatgttctcacgctcttaattatttagcaggttatctgaacgcaaaacattattgctgcatggataataaagcgagaaatgattttcaattaataagacagaataatgtaaatgaagccggatgatattaacgatcatccggctttattgatttacgagactaacatcccggtaaacacatacgcctgcagcagggtgataatgccgataacgctggcaaaaatcagactgtgcttcacggtgtagcggaacagttcagattctcggcccaccatgcccgtcgcggcgcaggccacggcgatagattgcggggagatcatcttgccagttacgccgccgctggtgtttgctgccaccagcagggtgtcagagacgttgatttgctgcgccgtggtcgattgcagtgaaccaaacagggcgttagaggaggtgtccgagccggtaaggaatacgcccagccagccgagaaacggtgagaagaacgggaacatcacgcctgtacctgccagtaccagcgccagcgtggtggacatgccagaatagttggtgacgaaggcgaacgccagcaccatgccaatcgacagtatcggccacttcaagctaattagcgtttcggcaaagacgccaatacctttcttgatccccacaccgaggatgaagatagagataatcgccgcaataaaaatagcggtgccgccagccgagagggggtcgaatttaaacaccgcatccattggcgttggttgggcgacaatgggtgccgctttcaacacttgttgatgcaaatgagggatctggaaattaatcaccagtgaataaaacgcgccgcccggagcaaataacgctttaaacggcttcatggtccagatggtgaccagcaccgttaagattaaaaacggtgaccacgctcgaatgatttgccccagactatattctgaaggcacgggaccgccagaagatggcttatttaccaccatcgcacctgcggattgtcccatgctgattgccgtttcggtatttttcggccgccagactttaaggaataaagcgagtgagacgatactcaccagcgccgaagtaatatccggcagttccggaccaatatagttagaggtaaagaactgagtgacagcgaagcttcccccagcaaccagcgccgctggccacgtctctttcacccctttccagccgtccatcattgctaccagccagaacggcacaagaaccgacaggaacggtaactgacgtcccgccattgcgccaatgtggaacggatcgattcccgttacctgaccggcgaccagaatcggcacgcccaacgcaccaaacgccaccggcgcagtattggcaatcagacacagccccgccgcgtataacggtttgaagcccaggcccaccagcagcgcaccggtaatcgccaccggcgcaccaaagccagccgctccttccagcaacgcaccaaaggagaaaccaatcagtaacacctgcaaacgctgatcgtcggtgatggagataaccgagctgcggataatatcgaactgcccgctggcaacggttaatttatacaggaacaccgccgcgacaataatccacgctattggccataatccataaataaagccatagcccgcagcagcaaatgccatatcaatcggcattttaaaggcgaatattgcaatcaggatagataatataagggttattgctccagcgacatgtcctttcagacgtaataccgcgagtgcaacgaagaagaatattatcgggatcagggcgaccagagcggatagccccagtcctcccatcggcatatacatttgggtccaggtaaccatattgttcagtctcttattatctttatatgcttgatatacttaaggttgtaataagcaaaagaggactgaactgtaaaatataggcgttatactttacagcaacagtacgccgctaacgcaattgctacctctggcataacaagtatatcgggtaagggtttctgttccgcacacgcagacgcagagtatcgttaagatgtccatattgttgttttaggcccgctagtaatgcgctacgggtatttaatattgttaaaccctgataatcgctccggttatttccgggataaatgtactaccgcagttactatcatagccccgacaataaaacttgccggggcttttttgacgctattaatgactttctttttcgcgtaaacgccaggcgtgtaataacggttcggtatagccgtttggctgtttcacgccgaggaagattaaatcgctggcagctttaaaagcacacgagttagcgaaattccccgccatcggacgataagccggatcgccagcgttttgctgatcaaccactttcgccatattctccagcgacgcctgcacctgttctttggtcagaataccgtgacgtaaccagttggcgatatgctggctggagatacgcagcgttgcgcggtcttccatcaacgccacattgtgaatatccggcacttttgaacaaccaatcccctgctccacccagcgcaccacgtaccccagaatcccctgcacgttgttatccagctcttgttggatctcttgcgccgaccagttagcgttttcagcaaccggaatagtcagcagatcgtccagcagcggttcaaattcagcattgaactcggtctgggcaatgttggcttgtacgctctgtacgttggtttggtggtagtgcagcgcatggagcgtagcagcggttggtgacggaacccaggctgtgtttgccccggcacgcagttggtcgcccttctggctgtacatgtctgccatcaggtccggcattgcccacatgcctttaccaatttgcgctttaccgcgcagcccacagaacagaccggaaagcacgttattacgctcgtaggctttgatccaaggcgtcgatttcatctgatttttacgcagcatcgggccagcttccatcaccgaatgcatttcatcgccggtacggtcgaggaaaccggtattgatgaacgccacgcggttgcgcgcctgagcgatacagctacgcaagttcagcgaggtccgacgttcttcatccataatgcccattttcagggtattcggtgccataccgagcattgtctcaatgcgggtaaacagtttgttggcgaacgccacttcctgcggaccgtgcattttcggtttcacaatatagacgctgccagtgcgcgagtttttctgcacttttaaatcatagagggcaatcgcgccagtcatgacgccatcaagaatgccttccgggatttcattgccttcgctgtcccaaatcacaggaatggtcatcaaatgacccacgttgcggataaacagcagcgagcgtccgtgcagagaaatttcagagccatcggcggcggtgtaatgacgatcgtcattcagtttacgcacgatttgccgaccgtttttctccattttctcttgcagagtcccctgcatcaggcccagcaggttgcggtacagcaggattttatcttccgcatcaaccgccgcgaccgaatcttcgcagtcgagaatggtactgatagcagcttcgacgataacatcgttgatgtgcgccggatcgtctttgccaatccgcccattggcatcgatttgcagctcaatatgcaggccgttatttttcagcaaaatgcaggtcggcgcagcggcatcgccacggtaaccgacaaactgtgctggagtacgtaacgtggtttctttaccatttttcaactggatgcgtaattgtttatcaaccaccttaaacgccaccacatcctgatagctgccgttttccagcggtagagattcatcgaggaaacgccgaacccaggcgataacctgctcaccgcgttgcggatcgtagccgctgaccatcgccccttcctgcgggatgatgtcgctgccgtataacgcatcgtacagtgagccccagcgagcgttcgccgcgttcagcgcgtagcgggcgttcattgccggaaccaccagctgcggccccgcctggctggtgatttcgctgtcaatgcccgtggtttccaccgtcacgcgctccggttgcggcaccaggtagcccagttcacgcaggaaagatttataggccgctttatcttttaccggccccggattgctgcgatgccactcatcaagcgctgcctgaatgcgatcgcgttctgccagcaactgacgattttctggtgccagatcatgaacgatctcatcaaaattgcgccagaacgccgcagcgtccagccctgttcccggtaaaacttcttcatccacaaaacgtttaaaattggcgtcaatgcgtaaacggctctgggttatggtttgactcattgtttatctcctcgttttcgcttatttcgccaacaccgctgctgccgctttcgcgacctgcgcatcctgtgctccggttaaaccagaaacgcccacggcaccaataatttgcccatccacaacaaccggtacgccgccttccagcgacgttaataacggcgcagtcacgaacgcggtacgtccgttgttcaccatctcttcatagcccttagtttcacgacgccccagcgcggcggtacgcgctttctcctgggagatataagccgcaatcggcgcgcaatcgtccatgcgacttaacgccagcagatgaccgccgtcatcggcaacagcaatggaaacagaccagttatttttctgcgcctcttcctgacctgcggcaataattgcactcgccatttgctggctaagaatgactttagttttcattttgttattccttttcaagggcttgttctacaatttcaatccagtgacgcacagaggtacgaccggcgctcgccagatgcgtctggcaaccaatgttggcggtgacgatcatttccggtttgccgctttccagcgcattcattttgttatcccgcagctggcgtgccagatcgggatgcgttaacgcatatgttcccgctgaaccgcagcacagatggctgtcgggaacgtccgttaaggtaaatccaagacgaagcaacactttttccacttcgccgttcagcttttgcgcatgttgtagggtacacggacagtggaaggccagctttttatcgccgcgaattgccagtttttccagcggttcctcgcgcagaagttcgactaaatcgaccgccagttcactgacctgacgtgctttatcggcatataacgcatcgtttttcagcatctgcccatactctttgacaaacgcgccgcagccgctggcggtttgcaaaattgcctcggcacctgcttcaatcgcgggccaccaggcatcaatattattgcgcgcccgtgccagccctttctcctgcgcattaagatgatagtccaccgcgccacaacagcctgcttcgttagctggcatgacgctgatccccagacgatccagcactcgcgcagttgccgcgttggtgttgggcgaaagcgtaggctgggcgcagccttccaacattaaaacccgacgcttatggcgcagcggcggacgcggtttagctttcaccgtttcagcaggcagttttgctctgacctgttccggtaaaaacggtcgcagcaccagccctacctgcgtcagcgcacggaagaccgccggacgcggcactacctggcgcaatccttcgcgcagtattcgctccggcagtgggcgtttcactttctgctcgacaatatcacgcccgatatccagcaaattgtgatagcgcacaccagaaggacaggtggtttcacaattacggcaagtgaggcagcgatcgagatgctcctgtgttttaagcgtgacttcgttgccttccagcacctgtttaatcagatagatgcgcccgcgcggcccgtccagttcatcgcccagaagctgataggttgggcaggttgcggtacaaaatccgcagtgaacacaggcgcgcaggatgctgtcggcttccagcgcgcgcgcgttctgccgcatctcttcagttaattgggtttgcatagcctgctcctcaaagttccgcgtacatgcgaccggggttaaacacgccgcaagggtcgagctgctgtttaagctgctggtgatagcggaataaaggagccgatagcggggcaaagccaccatctccggcactaaagcgggtcgcatgaccgccagcgttgcgggcgatgcgatggatttgattgtcctcggctgtcgatttcagccagcgtaacgccccgccccagtcgatcagttgctcgccgggtaaatccatcatcggcgcatcactgggtaatgaaatgcgccataaggtacctggtaacgagaagaacggcagttgttgttcacgcaattgctgccagaactgaccggcaacctcttcgccacccagcagttcacgcgctgcttttaccgatccttcgccgccctcaaggcggatccacaacgcattgtcgaagtaacataagccactaatgggtaatggctggagttgccactcggcgatttcactcatggcttcttgcaggctgatttcccgacgcaggctcagggaggcgcgcggtcgcggtaacactttcattgagatttcagtgagcacgccaagacaaccgtagcttccgaccattaaccgtgagagatcgtatccggcaacgtttttcatcacttcgccaccaaaacgcagatgttttccagcgccggtaatgatgcgcgtgccgaggacaaaatcgcggaccgaaccgctccacgggcgacgcggccccgccagcccgcaggcgaccatcccgccccaggtggcttcttcaccataatgcggcggctcacaggggagcatttgccccgcgctttccagcgccgcttcaattgtcaccagcggcgttccgacacgcgcggttatcaccagctcggtcgggtcgtaattaacaatgccgcgatgacaacgaacatccagcgtttgcccggtgacagggcgacctaaaaaggctttgctattgctgccctgaatcaccagcggcgttttatcgctaatcgcctgattcacctgctccagcagcgcctggctgtaatcacactcgcgtagcatcagaaacgctccagttcagggaaaggtaaatgaccgtgatgcacatgcatggcaccaaattcagcacagcggtgtagcgtgggaatgtttttcccagggttcagcaaaccatcggggtcaaacgccgccttgaccgcatggaaggtcgtgatttcatcgctgttgaactgggcgcacatttgattgattttttctcgcccgatgccatgttcgccactgatgctgccgccaacttcaacgcagagttcgaggatcttcccgcccagctcttccgcgcgggcaaattcaccgggttcgttggcatcgaaaaggattaacgggtgcatgttgccatctccggcatgaaagacgttggcaacacgtaaatcatattgctgcgataaacgggcaatgccttccagtacgccaggcagggcgcgacgcgggatggtgccatccatgcagtagtaatccggggagatacgtcctaccgccgggaacgcatttttgcgaccggcccagaaacgtacgcgctctgcttcgtcctgtgccagacggacgtcagtcgcgcccgctttcaacaagatgtcgttaacccgctcgcagtcttcctgtacgtcagactccacgccgtccagctcgcataacaaaatcgcttcggcgtcgacgggataaccggcatgaataaaatcttccgccgcgcggatcgacaggttatccatcatctccagcccgccggggataatgccattggcgatgatgtcaccaaccgcaagtccggctttttctaccgagtcaaagctggctaacagaacccgcgccacgggcggcttcggcagcagttttaccgtcacttcggtggtcacgccgagcataccttccgatccggtgaacagcgccagcaggtcaaaaccaggtgaatccagcgcgtccgatccaagcgtcagtgcctcgccgtccagcgtttgcacttcaattttcagcaggttatgtacggtcagaccatatttcaggcagtggacgccgccggcattttcagccacattgccgccaatggaacaggcgatttgtgaggaagggtccggtgcgtagtagagattatgcggtgcaacggcctgggagatcgccaggttacgcacgcctggctgcacgcgcgcgcggcgaccaacggggttaatgtcgaggatctctttaaagcgcgccatcaccaacaacacacctttttccagcggcagcgcgccaccagaaagcccggtgcctgcaccacgggtcaccaccggtacacgcaggcgatggcagacagccagaatcgctgtcacctgttccatttgcttaggcagaacaaccagtaatggacgcgtgcgatacgcgctcaacccgtcacactcgtaaggaatgatctcctcatcggtatgcaggatctcaagtccagggacatgctcacgcagtgccatcagtaccgatgtgcggtcgacatcgggtaaagcgccatcaagacgctcttcgtacaagatgctcatgagtaggcttcgctttgttgtgttgtgtggcagctgatttttgcgcgctgcttctgtgaacagttattaagcgggcttttcgttttcgtctatctctttagctaccggtcagaccattttttttccagctctgtgaccttgtcttggttaactcaatgttaaattgatgtaacataatcacttacgtgatgtgcgtgttttgcgagttaagaacagaaaaattggtcctacctgtgcacgaggtccgggaatgaaagatgaacgtcgccctatttgcgaagtggttgcagagagtatcgaacggttaattatcgacggcgtactgaaggtcggtcagccgcttccctcggaacgtcgactgtgtgaaaagctcggcttctcacgctccgcactgcgtgaagggctgaccgtgctgcgcgggcgcgggattattgaaacggcgcagggtcgcgattctcgtgtcgcacggcttaatcgggtgcaggacaccagcccgctgatccatctgttcagtacgcagccgcgaacgctgtacgatctgctcgacgttcgcgcattactggagggcgaatcggcaaggctggcggcaacgctgggaacgcaggctgattttgttgtgataacccgctgttatgaaaaaatgctcgccgccagtgagaacaacaaagagatttcgctgatcgaacatgcgcagttggatcacgctttccatctcgccatttgtcaggcttctcacaatcaggtgctggtgtttacgctgcaatcattgaccgatctgatgtttaattcagtgtttgccagcgtaaataatctctaccatcgaccacagcaaaaaaagcagatcgatcgccagcatgcgcggatctacaacgcggtgttgcagcggctgccgcacgtcgcccagcgcgcagcacgcgatcatgtgcggaccgtgaaaaagaatctccacgatatcgagctggaaggccaccatttgattcgctcggcggtgccgctggagatgaacctgagttagctggtattaaatctgcttttcatacaatcggtaacgcttgtacggctccgccccaatgcgttccagcatgttattcatgcctgtattggtttcgaggatccatgacatctccagcgcatcgatcttccggcgggcaaacggatcgcgtaaggcttcaatcaataacagcgcaatcaccgggccgatgcggctgaactgatactcgtcgcgcacgcccatcagcggtactcgcgcagttcgcacaccgctgactttcaaacgccacagcaattttgcccagccgaagggaaagagcgatccgttcagatcggcaatcgcctcgttgatgttcggcaagccgacaataaacgcgcagggtgcagaatcaatctcagcgatatagatcatatcgtccggcaccagatatttaagttgatcgcccatggtcgcgaattcatgttcggtaaacggcacaaatccccagttgtgctgccagccagagttgaaaatctcacgcaggatctgcatctcttcggcaaaccgctgacgattgatgcagcgaatggtcacctttttgcgcacctgatccatcagtttttttagcgccggagagaaagtgagatcggttcgctgcatccaccacgccagtaaatcaatgcctttgtgataacccagttgttcaatatgcgcggcataccacggtttgccgtgtggcatcatcgcacagggtggtgtgtcaaaaccttcaatcagtaatccgctttcctgattgatattcaggctgaaaggaccgctgatcttacttgcaccttgtgacttcaaccacgcttccgctgcgccaaacaacgcggcaaaaacctgcggatcatcaatggcgtcaatcatgccgaaatgaccggtatctttgccgtaacgctcgcggtgcaaggtatctatttgcgcggtaatacgcccaactatctgccccgctttttttgccacccacgcctgccagatgatatggtccgtccccggatttttcgcagacaaatgctcgttgcgttcaatgaataaagggggtatccagtttggatcgtcgggataaagtgatgacggaaaagcgataaatgccttaaggtcatttttattaaggaaggtgcgaacaagtccctgatatgagatcatgtttgtcatctggagccatagaacagggttcatcatgagtcatcaacttaccttcgccgacagtgaattcagcagtaagcgccgtcagaccagaaaagagattttcttgtcccgcatggagcagattctgccatggcaaaacatggtggaagtcatcgagccgttttaccccaaggctggtaatggccggcgaccttatccgctggaaaccatgctacgcattcactgcatgcagcattggtacaacctgagcgatggcgcgatggaagatgctctgtacgaaatcgcctccatgcgtctgtttgcccggttatccctggatagcgccttgccggaccgcaccaccatcatgaatttccgccacctgctggagcagcatcaactggcccgccaattgttcaagaccatcaatcgctggctggccgaagcaggcgtcatgatgactcaaggcaccttggtcgatgccaccatcattgaggcacccagctcgaccaagaacaaagagcagcaacgcgatccggagatgcatcagaccaagaaaggcaatcagtggcactttggcatgaaggcccacattggtgtcgatgccaagagtggcctgacccacagcctggtcaccaccgcggccaacgagcatgacctcaatcagctgggtaatctgctgcatggagaggagcaatttgtctcagccgatgccggctaccaaggggcgccacagcgcgaggagctggccgaggtggatgtggactggctgatcgccgagcgccccggcaaggtaagaaccttgaaacagcatccacgcaagaacaaaacggccatcaacatcgaatacatgaaagccagcatccgggccagggtggagcacccatttcgcatcatcaagcgacagttcggcttcgtgaaagccagatacaaggggttgctgaaaaacgataaccaactggcgatgttattcacgctggccaacctgtttcgggcggaccaaatgatacgtcagtgggagagatctcactaaaaactggggataacgccttaaatggcgaagaaacggtctaaataggctgattcaaggcatttacgggagaaaaaatcggctcaaacatgaagaaatgaaatgactgagtcagccgagaagaatttccccgcttattcgcaccttccctaaatcaggtcatacgcttcgagatacttaacgccaaacaccagcgaaatgagcggcttgccgacgatcaacaccgcgagcgccaccagaataccgattccgcccgccagtaaaccggacttcacacctaacaaccacggtctggtggtgcgcggatctaaacgcatcacctctgggtaaaaacttttacccagcaaacccgctggcgttccggcggcgtcgaagaatgtcatggcgattttaaataacccggcggcagcgggtcctaacacgatccccaccaacactgtgctgcacgagttacgcgccgaccagatggagtgggcaatgttggttgaccagacaaaactccacgcgcctttaatgtatcgggcagactcaaacagattcaatttgaaggcgttatggatatttcggcggcgtaattcgcgcgcggcaaaccaccagtacatggtgccgccaaccagattcgacacgtaccaggcaataacaaaacccgcaaaaccaaagtcaaaataccaggctacgacgctccccgctgcgcgcagaaaaggtttcgtcgcctgctgtacagcaattaaatcgaagcgatctaccgcacgcagaatgccggtcggcgtggaggaagccattgaaggaatgagcgtgcaatagagcgctgccagccaaaaactttggtcatccagacctaatgaatgggaaaggaatggcagtaaggcaatgccaccgacaatcgccaccgcgccgctgacgatatccagcgagaaggaaaatgagacgacattgcggaattgctgcggattattgttggttaatgctggtgttccgtactgaaccaccagttgccatgtctgaaacttaataaaatcgctgatcgacttggcgtacgattgcacaatcaccagtacgccaaacatggcgggcgtcatccctttaccggcacacgagagcgccaacagacccagcaaggcgctcacgacattactggagcctaaccaggcgctattgcgaataatggtgcgaaacgcgccatctgcaaaccaatgtttgatgttaaaacccgccaattcagcctgaccttatcgttgatagtaaaaagtatcccgccagccttaagttaaacttcggcggtcagaaacgatggcaaccagagaaaccgccttctgtgcctgttccagcacttcgctgtagggcgctctggaatcaatctcaagaatttttgtgccgttatagccaatcttcgacatgacaccgattttgtcctgcagctcggcatagtcatggtcaggcttgcgggagatggcagtctcaatatcaatgcccaggcgaataattaattccgggcgatattgcgccatttgttggtataaacgccgttcgcgctgcgccagaaacatgctgattttcccggtcgcacgttcgacgccaatccccggtccatcataataaaagcccgaaatttcagcctgcgggaagcgatcgctgaccaccagaacgccactttgcgccagtcgctgaaccttgcgtagattcgccattcttcgcagcgagaagcagtacataatcaccgccgcccatagcgccggagatttggttttcatgctttgggttttcgaggatttggccgccagtcgccgttccagccagacgccaaccaacggcaatcgtttgattttgtcgccgtcttcgccggagagcagccccagatagcgccgctcggtttgccagtgttgttgcagcgatttcaccaggtcggtggtcagtgtggatttaccggtgccatcacacccgaccaccgcaatcagccccggaatgtagttgggctgcggcgcggttgtactattaacagtttgagtttgtagtgcatccattcgttaaatcatcccctatccattttggtgatcaggaaagcgcggcgtgaattgcgcgtagtgacgcttgcagaatttcatcggcggggtgtcgcccatccagttcaaggatctttgcgccattgaatgtcagttgcggcgtaacggcgattttttcctgtaacgctgccagttggtggtcaggtttacgcgcaaacgcggtttgttcatcaatgccaagacgaatcaacaatacgggcaaataagatgccatccattggtacagcttcagctcgcgctgccttaacatttttatccaaccgttaccgcccgtggtttttgccaattgcgggccatcaaagcgaaaccccggcacttcaacctgcgggtagcggtcggtgatgagcagaaagccttgctggcttttacacaacattttgcgaaacttgtacgcccgccagcaggaaagcagatagataaccagtgcagtaatattgccaggcggtgttgagggcttttcgtgcacatgtgccgctttacttcgcagataacgcccaaaaggtgcgccaataacagggagctgtgaaatccattcgccaattcgcccggacgattgcccgagataaatgtgttctgttggcattcttgctgccagttcatttaccaggcttgccgtgagggtcgatttacctgaaccatcacatcctacaatggcaataacacgcactggcgtggaattaattattgacatattacgttgattcacgaaaaacccggcagtaaataatgtattgaatattacgtggtccgtgctcagaatatccgttcaaccttattgtgacaatggttaattgtgacattgacctgaattacgctttcataaaaacatattaaccaaataaatatttttaatggatatttaaattaaaggatatattcatgcagtcaataacacctccattaattgccgttattggtagcgatggttcaggcaagtcaacggtgtgtgaacatcttattaccgttgtcgaaaaatatggtgctgccgaaagagttcatttaggaaaacaggccggaaatgtcggtcgtgcagtgacaaaattaccgttgatgggaaaatccttacataaaacaattgaacgaaatcaggtgaaaacagcaaaaaaattgcctggaccagttccggcgctggtaattacagcgtttgtcgcccgtcgcttactgcgctttcgtcatatgcttgcctgtcgtcgtcgcgggttaattgttctaaccgaccgttatcctcaggaccaaattcctggcgcttacgatggtacggtgttcccacctaacgttgaaggtggtcgttttgtctcatggctggcaagccaggaacgtaaagcgtttcactggatggcgagccataagcctgatctggtcatcaaactcaatgttgaccttgaagttgcctgtgcacgtaaacccgaccataaacgggaatcgctggcgaggaagattgccataacgccacagttaacctttggtggtgcacaactggttgatatcgatgccaatcagccactggaacaggtgttggttgatgcagaaaaagcgattacggattttatgaccgcgcgtggttatcactagtcaaaaatggaaatgcccgatcgccaggaccgggcattttcaggaaggttaaatcaactgcaatgctatccagtacagcccaccagaaagaaaaattgccgccggtaaagtaaatacccacgccatcaggatgctggttaccgttttacgctgtaacccaccgccgtccaccaccatcgtccctgcaactgcagacgagaggacgtgtgttgtggagacgggcatcccaatataactggcaagaccgatagacactgccgccgtcatttgtgccgccatgccttgcgcatacgtcatgccgcgcttaccaatcttctcaccgatggtcatcgctacacgacgccagccaatcatggtgccaatgccgagcgccagtgctaccgccatgatgatccacaccggagcgtactcaatggtgcttaacatatcgctgcgaagttttttcagcaggttctggtcttctttactgacgcctggcagtttcgctagcttcgcggaggtatcagagatgcacagcataatgcggcgcagctggctgcgctgactcacgcttaacggctcgtaactttccatattgcctggcagcatcgttttaacgcgcgcaatagcatcaaaggtatttgccggatgacagtgaaactctgttacttgcgtgccatcagtcgatgctgcaggcaatggaggttccatcgcaatcaacttctgcggcagttcaggatgctgttgcaggtagtgttcgaagttggtaacggcatcgcgggtacgggtaatttcatagccggacgcattcatattgacgacgaagccagcaggggcaatccccaccagtaccagcattaccaggccgatccctttttgtccgtcgttcgcgccgtgcgaaaacgccacgcccgcagcggaaacaatcagcgcaatacgcgtccagaatggcggtttacgtttgccttttttctttttgcgatcttccggaatgcggtgaatacggtcacgctttttcgtcccgctccagtagcgtcgcagcaggaatatcaggcctcccgcaatgaccaggccgacgataggggaaacaatcagcgaggagaaaattttggtcacttcacgcaggtttaacgcatccatcaccgatgagccggttaacagcgcgttggttaaaccgatgccgataatcgcaccaatcaaggtgtgcgaactggaggccggtaaaccgaagaaccacgttcccaggttccagataatcgccgccagcagcatggaaaagaccatcgccaggccgtgggttgaccccatattcagcaacaaatcggttggcaacatatggacaatggcataggcaacgctaagtccgcccaataacacgccaaaaaagttaaaaaatgccgccatcaccacagcaagttgtggttgcatggcacgagtataaataacggctgccaccgcattcgccgtgtcatgaaaaccattgattgcttcgtagaacaacacaaatgccagagcaagcaataacaaaagccctgtgtatatatcaaggccaacaaataaatttagcatatattagattacgccattttgaatttacgaacggacgcattatcagtgactttaacggcatgggcaaagtgaaatatcattttttaacgataaaaagagtgttatttcttgtgtatcagacaataagcattcattcaaaacctttagaaataatcaaaacacaggtattccactggttaatatattcacatatgaaatgaataaatattggaatatataaatattgaatattttgattaatccccgtactgattattcttcataatcagtacggggttgctacaacatgtattactttttcaccacaattaacggttcaatatcactctcttttttgatgaccagtgattcatcaccgcgcaaacacgtcccaccgtagttgccgccaacggtgaaggtacatacctgaatgtatttaccgtccactttcggcaaacaccacagttgctgatagatgtttttctgctcggcaaatttaccgctggttttgtccagcacctcttcatgatggctgacgaggtcgatattgctgccacagcgaccggcgatcggtttcactgcgtaacctgttttcaccagttcatcattaacagtgaaatcggtatccagcaggtaacgatggtgcgggaacagcgaccagaggatcggcagaatcgctttgttgccggggatcaccgtccacagcggctcaaagaccagcacttccgggcgcagcaatacgtcgataagacgcacttcgttttgcggatgaccggtacggattggcaccgcagcaaactcacggtcgctaacttcacgaatctgatcaaacgcggtttcccacgcccaggttttccacacgcagttaaccagtcgcccttccccatcaatcagttgcccggcagcatcccagcccagttcatccaatccacgcaagatacgcgtttcaaagcccgcctggtgcagcgcctgctccataaactgcgcgtgatagttttcctcgatatctttgtcctgcatgatatggacaaacggacgtgcacgactgtgtttccaggcaccagccaattcgttaatcagcccttccgccggattgaagccgttgcctttatagccctgctccgcccaacgttcgaggatcaagcccgcttcggtatgacaggaggcggagtcggcgttgtactcgtaaaccttcaggccacgctcatccatgcagaaatccatacgaccagtgatcatatggtgacggcgacgctgccaggagagacgcaaacgtggccagaggattttcgggatgtcgaacagcgccagcaggttgtcatctttcagcaccttgtcggttgcgtgaagatacatcaggtgcagctcgttggtggctttaattagctcctgctcggcactctcggtaatggtgtagtaatgataaggatcctgattgatcacctgaccgttggcctgcacataggcgttttgcagcggatctttttcatccagccatttaccgtcaaactggcctttgttttccaggcgcgctccgctgattttcagcagctcgcctgcaatttccggctgcggtaagctgtattcagtatcttccgtctggatcatccagcccagaatggtggtgtcatcaaaagtgtctttcagggtatagcagccgttttcgaccaccatctccagctcgcgcgtccactgttgcccttgcggcaacggggaatgaatcacgttctgttccgcaatacggactttgttgccatgcaattgggtaatgatggcgacatggccagtgtctttaaattcaccgcctttatcccagataagaagcgcacccgcgaccggcgcacgcggcgagccgttaggaaatgcctgcaatggcaggatgttgtcattaaccacttctcgcaggaagcgcagcgagaaaatctcccacgccatacccacgtcagtaaagaccacaccgtaattcagaaagagaaaacggcgagcaaattcaacgcattgccacttgtggcccatatattcgtcgtcgatatagctacggaatacggcgtcatcttcgtattcctgcggatcgagagaactgtaatctgaagagtagattgctaccccacctggggcgtagcccaataatgtcccgaacggggcatcctggctggtcgttcctttgctcatcactttacctttaacaatacaacctaagcagttggcgtaattgttgtgctctgattacctgctcagcgacattaaccggacagaggtcagactaatcatacacctcatcgcagcggctggcgcaaagggttaaaaaattcacattctgtacagcaagtgacctgctacactgcttcaacactaccactcagaaggcaactcactatgacagacaatacttatcagcccgcgaaagtctggacgtgggataaatccgctggcggcgcgttcgccaatatcaatcgcccggtttctggtccgacgcatgaaaaaacgctgcccgttggcaaacacccattgcaactttattcgctgggaacgccgaacggtcagaaagtaacgattatgcttgaggagctgctggcgctgggcgttactggtgcagagtacgacgcctggctgattcgtattggcgatggcgatcaattctccagcggctttgtcgaagtgaacccaaactcgaagatcccggcgctgcgcgatcatacgcataatccgccgatccgcgtgtttgaatctggttcgatcctgctttatctggcggagaaatttggctacttcctgccgcaggatttggcaaagcgtactgaaacgatgaactggctgttctggttacagggcgcggcaccgttcctcggcggtggttttggtcacttttaccattacgcaccggtaaagattgagtacgccatcaaccgctttaccatggaagccaaacgtctgctcgacgtgctggataagcaactggcgcagcataagtttgttgcgggcgatgagtacaccattgcggatatggcgatttggccgtggtttggcaacgtggtgttaggtggtgtgtatgatgccgctgagtttcttgatgcgggcagttataagcatgtacaacgctgggcgaaagaagtaggcgaacgtccggcggtgaaacgtgggcgtattgttaaccgcaccaacggaccgctgaatgagcagttgcatgagcgccatgacgccagtgatttcgagacgaatacggaagataagcgtcaggggtaagggttggtgttcgtcgcagcaagccatccaggccggataaggcgttcacgccgcatccggcaatcgtgcacaatgcctgatgcgacgctgccgcgtcttatcaggcctacgaaagctaatcatcacgcgctggtaatgtcgtaatccatttggcgcagtgcgtctaatgtggctttggcttcatcttcgtcgatgatgctcatggcaaatccgacgtgtaccagcacccactggcccagtagatcggcagggttaccttcacaaatcagggcgatattcacatcgcgcttgataccacatacttcaacctgcgcaagctggtgaatatcttcaccgacagccagcacctggcctggaacgccaatacacattattaactccggttattcaacttcaatacttttgacgatcagcgaatcgccggtatcgacacgcaaccgctcgccgtgacagagcggacactgcgcatcgtgctgatgaatctccaccacctggctgcaatcccagcaccaagcctgggcgggtttatagacgatatgtaaatcgcacccttgcgccaccgttccgtggcagacaatttcaaaactaaaacggacggcgctctcctcaacgcaggagagcgcgccaatttccagccacacggcggtgacgcgcttaacatcgtgctgctccgcctgccgttggataatttcaacggcgctctggcaaagagacaactcatgcattttcgccactcctgcgaccaaacagcagggcgcgacgccctgcgtgtggtacatccggattcgtgactggcagcgaaaggatcattcgtgcgcagtcatccgtcaggcgttggccctcttcaatcgacatgctgtgcgaaagcggcgacatcagcgaacaggagagatattgcgaaacaccgtccagttcgccaacggtaaaggtcatagtgccatacggcagttgcagaccaattttttcactcactttgcgcagcggccagagttgatccgggccggggaagataactgcactcagcatccacggggtgatcacacaccccgtccactgaccttcgaacagcgtaaaatcagaaacatacaccggcattgaaggatgcagaaaagagagatcgtgcatcgaacgccgggcaatttcttcaaacgctgcctgtacttgcgccttcggggaggtctggaaacctgctatctcttcagtcatgaatcgcctcccgtgggatggcttccacgccagattcacgcagcgcagccagaacctgctcaagcgcaggttcaatcattgcttcaaccgtcggcgttaagccgatgtgtggctccagcgattccgggatcacgccgaccagggtcagctttttcggaaactcgccggtgaagcgcagggccgacaagacgtcggccaggccaagctgatgcggagagattttgttggtaaacaacgccggaacttcttcatcccgcaggatcatcatcgttcccggcgcgttctttttcgagacaatggcatccgcaataatcaaatgatcgcgatttgccatgtcgccaagcagctccattcccgccgtgccgccatcgaggatctcaacataatccggcagaatgtatcgttgctctaacgcttcgacaatccgcacaccgatggcttcatcggtcagcaaaatattgccgacccctaagactaaaatacgcattacagaaccttcactgaaaccacttcgttgccgtcagcatccactacgtgtaccgcacaggccatgcacgggtcaaaggagtgaatggtacgcaccacttccagcggtttattcggatcggcaaccggtgtacccaccagcgactgctcgtaaggaccgacgtcatcattgaagttacgcggaccagagttccaggttgatggaacaaccgcctggtagttgctgatgataccgtctttaataaccatccagtgagagagcataccgcgcggcgcttcgaggaagccaacacctttgaattcacccgttgccggaatgttcggcttcacaaaggtggtgtgatcgcctttgccgatattggtgatcagtgcactgtattggttttgcaggatatcctgcaattcacagcagtgaacggtacgaccaataatacggcccagcgtggagtgcagctgtgccacttccagcgtgttgccagtcagtttctgataaatcgcaacgatttcattcagtttgttctgggtagattcgcgacctgccgccagtttcaccagcatattagccagtggccccacttctaccgttttgccgtagaaagtcggtgatttcacccaggaatatttcccgtcgtcagaccaaccatcataagccggaatggtggtgccttcccacggtgcctgcggcgcttcgtctttataccaggagtgcttcgcgctttcctgaatgcctttgatcaggtattcatcggaatgagaagtgatcggacgatacgaggacagatccgcattctcaatgtagccgcccgggaacaggaagctgccgtttttactgtcggtcgggaattccggcacgctcaggtagttcaccgcacctttaccgcgtgtcagccattccgggtagaacgcggcaataactgcggtatcaaccttataaacctgctcaacaaagtcgctcagtttgtcgatgaaagacttgatgtacatcaggcgctcaaggttcagcacgcccaaaccgtcgaggttgatcgggttcgcgacaccacctaccgccaggttctgaatgtgcggcgttttaccgcccagcagcgccacgacgcggttagcgtcacgctggcactccaacgcttgcaggtagtgcgctaccgcaatcaggttcacttccggcggcagtttcatcgccggatgaccccagtagccattagcgaaaatacccaactgaccgctggcaaccagatctttgatcttgttctgaactttggtgaactcttccggactgttcaggtgccaggtcgaaacgcctttcagcatttcggaggctttggttgggtcagcttgcagtgcagaagtgatgtccacccagtccagcgccgaaagctgatagaaatgaacaatatggtcatgcgtggtgtgcgcagccagaatgatgttacggatgtattgcgcgttaaccggaacgtcgatattcagcgcactttctgccgcacgaacggaagacagcgcgtgagtggtagtacatacgccacagatacgttgcacaatcatccatgcatcgcgcggatcgcggtttttcacgatctcttccatgccgcgccacatggtaccggaagcccatgctttcgaaacgacgccattttcgatttcgcaatcgatgcgtaaatgcccctcaatacgggttaccggatcaatagtaattctctggctcatgctttgctcgcctcatgacgattatgatcgttttgttttaaaggaggaagtatcggcagtagacgaatgagtacgatgtaagcgcaaatctcaatagccacaaaaccaatagaaatcaacagttcttcccaggtcgggaagtaggcgtaaccgccgcccgggttgaatgccaccagcgaataggtcagacgccaggttgcacaacctaacagtgcgctcagtgctgacaggaacagcatgcgggaatcattacgcagcttcgccacacgcagaacgaccagcgggaagagcatcagcaggacttcaatccagaacatcacggagtagaagtcaccggcaaacgctaacgacagcttgtcgcgatagataagctcgccaaagcgcagcacgatgaaaatcgccagcaacacactgatggtgttggtcagcttaacaaacagactcttttcatccggaccgttgccacgcagacccgcctgcaccagcgaaccttcaaagatgacaatcgagaagcccatgatgaacgccgtcagcagcgagaacagcggcaacatttcatagctctgccacaacggatgcaccttgtagcccgccgagatcatcagcgaccccattgaagactggtgcatggtcggcagcagcgcaccgagcgcgatgatgaagaacatcaccttgtttagtcgctgtagcgacaccttccaccccagacgttcaaacagtgccggagcaaactccagtgccatcacgccgatatagatggtcatacagaccgccgtctcgaacagtaccgagttcacgttgaagtgacccggaatgtagaagtacggcaggttccagtagcgacccacgtcgatagtgatcgacaagccacccagtgagtaaccaaacagactcgccaacagcgccggacgcaccagcggatggtattgcccacggttaaagacgtataccgcccacgccagcgcccagccgccacaggcaaagccggtgccaatcagcaggtcaaacgcgatccacacgccccacgggaagccgccgttcaggtcagagacagagcccagaccgaacaccagacgcttcacaatcaggagcatacagatgacgattaacggtccaaaaatcatgaccggtttactgatgattttgccgcccagcggttgtggatcatgactcatgatcgtctcctccgtcgtgatggtcgtttttggtgttgcgacgaaccagcacggttaagcccgccagcacagccagtggtagcatcatgcctttatacagggtgtgttgaatattttcggaacgcgcaccggtagaaagatcgtccagtttcggcaggtcgagattttcataaggcacacccgtcagtaccagaacctgagtaccgccgccctctttctcgccgtacagatgcggataatatttcggcaccgtatgcaggtaagtgtcgccagatttcagcgtctgacgcggatagtggtattcgctgccaggcttcagcgccagacgttttttcgcctccgccatcagctcttcacgcgtaccgaaaatcaccgcgcccgccgggcacacttctacgcagccaggtagaccgcctttatcgagacgttccacacctttctggttgcacagctcgcacttatgcagcgcaccaaacgggttgttgtagtcgtacttcggcacgttgtacggacaggcgaccatgcagtaacggcagccggtgcacacatctttgtcgtaatggacaatgccggttttcggatcttttttcagtgcagagaccgggcacacagagacacagttcggatcgacgcagtgcatacactgtttcttaatgtacgcgtagccgttctcctcctggtctttgttgacccctgtgccgctggtccacacctgaatgatgttattggtatacggcgacagtttgtcgttgttcgaccaggtctgttccccttgcgggttacgttcagggaaattgatatcctgacacttggtgacgcaagcctggcagcctacgcacaaggtcgagtcgtacaacatccccagcgatcccggaattggcgggcggttttcagcagccgcatgactgacagacggcagcgcgcccgtcagcaatgccccgcaggaggctgctttaataaaattacgtctgttcacggttattctccccgtgagtcagcgttatctttcttttgctgacgacccagttcacgcaccgccatcacgctgacaccggcaaccaacccaaccacaccgccgagcaaaccaatagcgcctgcagagacgttgccgccctctttagcgttaacatccggtttctgtgaacgcggagtttgattttcgacgttggcaagctgatggatgcctttatggaagccgataccttcttcgttacagccatagcaagggtgaccaatcgccaccggccacacaccgccaacatcgcagaattgcagcgttgagcagttgccgtaagtttctggccctttacagccgaggtggtacaggcaccagccttcgcggtggccttcatcaccgaactctttggcaaaacgaccagcatcgaagtgcgggcgacgttcgcagtgttcgtgaatcagacggccataggcgaaggtcggacggtttttgtcatccagtttcggcggtttgccgtaagtgatgatgtgcgcaacggtcgcgaggaagttgtgcgggttcggcgggcagcccggaatattgataacggttttgcctggcagaacttcttgcaggctgactgcgccagttgggttaactccagctgcggcaacaccgccccacgcagagcaggaaccgatagcgataatggctgctgcgccttccgccgctttgcggatgtgatccacaatcggctcaccggcaaccatgcaataaataccgttatcttttaatgggatggaaccatccaccactaacacatactgccctttgtacttctcgagagcgttatgtttgttctcttcgacctgatgaccgaaggcggcggaaagcacttcgtgatactccagagagatagtctccagtacgaggttttctaccgttggatgcgttgcacgaagcagagattccgtacaaccggtgcactcctgcgcgccaatccagataactggcggacgctgcgggttagtaaccgattcggccatctctgcagcggctttgctacttaaccccatggtggcggctaatgctgcacaaagcttcatgaaatcacgacggttaatgccgtgagaatggatgagggtgttatctccagtcatttatagttattccgttgcgaagacctggcatatattttgcctcaatcgcaaaatcaataatgcgatcgatgcgccatttaccacacatttattatggttatcgatatcatgatactgcggcggggcgctaaaacgaagggaagaagcattagtgtaattaattaaagcaagataatacgtatgtttgatcaattttcgaggcgataaccggccataaaaaagcgcaacgtagaacaggaattattctcacgaaagaaatccattaccatctctttatccagtccatagcggcgcgtcagaatacccgcttcccaggcgctaagctggcgatctccggtcttttcgtacatccggtgtgagtagcctaatacaaaaccgcgtttataatcggcacagaattttgtcacattaaccgcactgtcggcatgcgttgcttttaatcccgccattaagcctttaccaaaatggttattcatcgttcacctcattcgctatatattgtcatatatagcgatattttaggcaaagaacgacttttgcgcacgctattttttcatgcttgtttaagacgtaatcccgtaagagataaacctatcaggagagatatttatcgaaccatttcagtgtcctttgccaggcaagatcggcggcagatttgtcataacggggcgtggaatcattatggaatccgtgattaacccccggatagatatacgcctcataaaccttattattggctttcaacgccgcctcgtaagcaggccagccctcgttgattcgggtgtccagttccgcgaagtggagtagtaaaggcgcttcaatcttcgccacatcggcagtgggtgcctgacgaccataaaacggcaccgcgcaggccagttccggatacgcgacagccgccgcgttcgatacgccaccgccatagcaaaatccggtaatacccactttgcctgtcgcttgcggatagcgttgcataaactcaattgcggcaaagaaatcattcatcagtttgttggatcaacctgctgttgcagctcacgacctttatcatcatttcccggataacctccaacggaacttaagccgtcaggtgccagggcgatataccccgccttcgccactcgccgtgccacatcttcgatatacggattcagtccacgattctcatgcaccaccactacggctggcgttttgccgctcatctttgcgggcttcaccagataaccccgcacctcgccgtgaccatttggcgaaggatacgtgatgtactcagcaacaatttccgggtcggtaaactctacctgagtcgccagcgcataatttggcttgagcaaatcaaacaacgctaatgccgtcatcccgcctaccgcacttcgccgcaaggttgaggaactcacgtttcgagattttcccgtgagcgtaatagtcatagtaatccagcaactcttgtgggaaatctttggcggttaaacgcggcatcgttgcactcctcagttggtgtttttttaagcaaagcataagcacgtatttttgcccagtttttcgtcactctgtgagccagactacgggatacgcgctggcgaatcgctaaactagaaacattgtttcgaaattgaacggtggaaaggagaggtcatggtctggttagcgaatcccgaacgttacgggcagatgcaataccgctattgcggaaaaagtggtttacgcctgcccgcgttatcgctcggtttatggcacaatttcggtcacgttaacgcgctggaatcacagcgtgcgatcctgcgtaaagcgtttgatttgggcattacgcactttgatttagccaacaattacgggccgcctccaggaagcgcagaagagaactttggtcgcctgctgcgggaggattttgccgcttatcgcgatgaactgattatctctaccaaggctggctacgatatgtggcccggcccttacggctctggcggttcacgtaaatacctgctcgccagcctcgaccaaagcctgaagcgtatggggcttgagtatgtcgatatcttttactctcatcgcgtcgatgaaaatacgccgatggaagaaaccgcctctgcgctggctcatgcggtacaaagcggtaaggcgctgtatgtcgggatctcctcttactcgccagagcggacgcaaaaaatggtcgagttgctgcgcgagtggaaaattccgctgttaattcatcaaccttcgtacaatttactgaaccgctgggtggataaaagcggcctgctggataccctgcaaaataacggcgtgggctgtattgcctttactcctctggctcagggattgctgaccggaaaatatctcaacggcattccgcaagattcacggatgcatcgtgaagggaataaagttcgtggtctgacaccgaaaatgcttaccgaagccaacctcaacagcctgcgcttattgaatgaaatggcacagcagcgtggacaatcaatggcgcaaatggcgttaagctggttgctgaaagatgatcgcgtgacgtcggtattgattggtgccagccgcgcggagcaactagaggagaacgtgcaggcgctgaataatctgacatttagcaccaaggagctggcgcagattgatcagcatatcgccgatggcgagctgaatctgtggcaggcgtcttccgataaatgacctgttaataacgggcgcgcgaaccgcgcccgaatcagatcagtgattatgacgagtcagtcggtcaagatagcccatcacaaatgcagaaagcacaaacgtcagatggataatgacgtaccacatcagtttgttatccgggacatttttcgcatccataaagacgcgcagtaagtgaatggaagaaattgccacaatcgacgctgctactttgtttttcagcgacgttgcgtccattttccccagccagttcagcttctctttgttctcggagatatccagctgtgagacgaaattctcataaccggaaaacatcaccatcaccagcaaaccgccaaccagcgtcatatccaccagcgacagcaacacgaggatcaaatctgattccgccatcgagaagatattcggcagtacgtgaataatctcctggaagaacttcagcgccagggcaactaacgccagcgaaaggccaaagtacacgggggcaagcagccagcgagaagcatacattgcattttcaagaaaacgttccatacattcctgtcgtgtagttaaaacgggcaacagtatatcgcaattgagtaaacagcacgcaacagcaaatcaacatatacgttaaacctttgtcgcataattctgaggtttagggatcttcctggttcccttatcaacgcatcgagaacgtctacccttaaaggacgttgaacctgaagggagaaaaacgatgtctcatttaaaagacccgaccacgcagtattacactggtgaatatcccaaacagaaacaaccgacgccaggcatccaggcgaagatgacaccggtaccggattgcggcgagaaaacctatgttggtagcggtcgcctgaaagatcgtaaagcactggtgacagggggcgattccggaataggtcgcgctgccgccatcgcttacgcgcgtgaaggggctgacgtggcgatcagttatcttcccgtggaagaagaagacgctcaggatgtgaaaaagatcattgaagaatgcggacgcaaagccgttctgctgccaggcgatttaagcgatgagaaatttgcccgttcgctggttcacgaagcgcacaaggcgttaggcgggctggatattatggcgctggtcgccgggaaacaggttgccattccggatattgcagacctcaccagcgaacagtttcaaaagacctttgccattaacgttttcgcgctgttctggctaacccaggaagcgatccccctgctaccgaaaggtgcaagtatcatcaccacttcgtcaatccaggcataccagccaagtccgcatttactggactatgcggctacgaaggcggcgattctgaactacagccgtggcttggcaaaacaggtcgcggagaaaggtattcgggtgaatattgtcgcgccaggcccgatctggacagcactgcaaatttccggcggacaaacgcaggataagatcccgcagtttggtcagcaaacgccgatgaaacgtgcggggcaaccggcggaactggcccctgtatatgtttatctggcaagtcaggagtcgagctacgtcaccgcagaagtgcacggcgtgtgcggcggcgagcatttaggttaaaaaaatgcccggttgtgaaaagcaaccgggcatcattgtgaattcactcttacctgatgtggcgaaaacgccttatccgcctacaaacgcatgaagattcaacatgttgcaatagattttgtaggcctgataagcgtagcgcatcaggcattgagcacctaatgccggatgcgtcgtgaacgccttatccggcctacaaacgcacgaagattcaacatgttgcaatagattttgtaggcctgatgagcgtagcgcatcaggcaattctactttacttcgctttggcggtttcttcgccgaccagacctatcttcaggtaacccgcctgatgcagcgtatccattaccttcatcaacgtctcgtaatcgacggttttgtccgctcggaagaagatggtggtgtctttcttgccttcggttaacgcattcaacgccgtaatcattgtttcatcggtgaccggatcgttaccgataaacatcgagttgtctgccttcaccgacagataaaccggtttttccgggcgcggctgcggcgtgctggtagaagcaggcaagttcaccttcacatctaccgtcgctaacggtgccgccaccataaagataatcagcagaaccaacatcacgtcgataaacggcgtcacgttgatatcatgcatttcgccgttatcgtcgaggttttcgttaagatgcattgccatcggatattatcctgcgcgtaatttttgtgcgacacgaaccggatgcgcagcggcgctggcttccagatccaggtcacggctttgcagcaacaatacctgcgctgcaacatcacccagcatcgctttaaagccgccaatctggcgtgcaaatacgttatagataacgaccgcaggaatcgctgccacgaggccgattgccgttgctaacagagcttctgcgatacccggcgcaacgactgccaggttagtggtctgcgtttgcgcgataccaataaagctgttcatgatgccccagaccgtaccaaacagaccaacgaacggagaaatcgcgccgatggttgccagatagccgttaccgcggcccatttgacgacccactgcggcgacccgacgctccagacggaagctggtacgttctttaataccttcgttatcgtcgctgccttctgacagttccagctcattctgcgcttcattgagcaaatgcaggcttaagcttttgctaccaaaatcagcggcgatatcgttggcctggtttaaggaacgcgcttcagccagcagttgctgctcgcgcttaaggcgacgcttctgattgaagaactctacgctcttactgaagaagattgcccaggtgactacggaggccaaaataagcccaatcatcacgcacttaacgacaatatcggcgtgctgatacataccccagacggaaaggtccgtctgcattaaattattacccactgtgtatctccaggacgcaagtcacaaaatctgcgcataataatatcaaaacgacgtcgaattgatagtcgttctcattactatttgcatactgccgtacctttgctttcttttccttgcgtttacgcagtaaaaaagtcaccagcacgccatttgcgaaaattttctgctttatgccaattcttcaggatgcgcccgcgaatattcatgctagtttagacatccagacgtataaaaacaggaatcccgacatggcggacaaaaagcttgatactcaactggtgaatgcaggacgcagcaaaaaatacactctcggcgcggtaaatagcgtgattcagcgcgcttcttcgctggtctttgacagtgtagaagccaaaaaacacgcgacacgtaatcgcgccaatggagagttgttctatggacggcgcggaacgttaacccatttctccttacaacaagcgatgtgtgaactggaaggtggcgcaggctgcgtgctatttccctgcggggcggcagcggttgctaattccattcttgcttttatcgaacagggcgatcatgtgttgatgaccaacaccgcctatgaaccgagtcaggatttctgtagcaaaatcctcagcaaactgggcgtaacgacatcatggtttgatccgctgattggtgccgatatcgttaagcatctgcagccaaacactaaaatcgtgtttctggaatcgccaggctccatcaccatggaagtccacgacgttccggcgattgttgccgccgtacgcagtgtggtgccggatgccatcattatgatcgacaacacctgggcagccggtgtgctgtttaaggcgctggattttggcatcgatgtttctattcaagccgccaccaaatatctggttgggcattcagatgcgatgattggcactgccgtgtgcaatgcccgttgctgggagcagctacgggaaaatgcctatctgatgggccagatggtcgatgccgataccgcctatataaccagccgtggcctgcgcacattaggtgtgcgtttgcgtcaacatcatgaaagcagtctgaaagtggctgaatggctggcagaacatccgcaagttgcgcgagttaaccaccctgctctgcctggcagtaaaggtcacgaattctggaaacgagactttacaggcagcagcgggctattttcctttgtgcttaagaaaaaactcaataatgaagagctggcgaactatctggataacttcagtttattcagcatggcctactcgtggggcgggtatgaatcgttgatcctggcaaatcaaccagaacatatcgccgccattcgcccacaaggcgagatcgattttagcgggaccttgattcgcctgcatattggtctggaagatgtcgacgatctgattgccgatctggacgccggttttgcgcgaattgtataacattgccacttttggacaattttgcagacattttattgtgaaaagtcttaaattgttgcgtccgggatcaaggcgtcccggacgattcaggagtacaataggcagataaaggcttaaacgctgttccacaggaaagtccatggctgttattcaagatatcatcgctgcgctctggcaacacgactttgccgcgctggcggatcctcatattgttagcgttgtttactttgtcatgtttgccacgctgtttttagaaaacggcctgctgcccgcctcatttttgccaggcgacagcttgttgatactggcaggcgcattgattgcccagggggttatggattttctgcctacgattgcgattctgaccgccgcagcaagtctgggctgctggctaagttatattcaggggcgctggttagggaataccaaaacggtgaaaggctggctggcacagcttcctgctaaatatcaccagcgcgccacctgcatgtttgaccgccacggtctgctggcgctgctggctggacgttttcttgcatttgtccgtacgctgctgccaaccatggcgggaatttccggtctgccaaaccgccgcttccagtttttcaactggttaagtggattgctgtgggtcagcgtggtaaccagttttggctatgccttaagtatgattccgttcgttaaacgccatgaagatcaggtaatgacgttcctgatgatcctgccaattgccttgttaaccgctggcttgttaggcacgctgtttgtggtgattaaaaaaaaatactgtaacgcctgacgattttccccgttcccggttgctgtaccgggaacgtatttaattcccctgcatcgcccgcattcttgccgcatcttcccccggcgtcacaccgaagtaacgtttaaactcacggctaaattgcgatgcgctttcatagccgacgcgcatcgctgctgcgctggccttcatgccgtcatggatgatcatcatccgcgccttatgcagacggtaattcttcaaatactgcaacggcgaggtactggtgacagacttaaaattatggtggaacgccgatacgctcatgttggcttctgccgccagttgctcgacgctcaggttttcggtgtatttattctcaatccgtttcagcacgcggctaatcagactgaagtgagtctggcgactgaccagcgccagtaacgcgccgccgcaaggtccggtcagcacgtagtacagaatttcgcggatgatctgtttgccgagaatacgcgcatccagtggtcgctccatcacgtcgagtaaccgctccgccgcgcataaaatctcttctgataacgtggcggagttaatcccgctggctgccatcgacggctggaaatgctcatcttcgccaatgtccatcaacagttcctgtaactgcaaaatatcgacattgagacgcaaccctgccagcggcacctctgacgtggcataggtttcgcactcaaacggcaacggcaccgtcagcagcaggtattcattggcatcataacgaaacacgcgttcattgatataaccgattttatgcccggaaaagagaattatgatgccaggctcgtacatcaccggtgtacgtgcgaaaggcgtctcgccatacaacaaacgcacatcgggcaacagtcctgacaaactattttctttatttttcagtttattaactttatccgccagcaagcggcaaatctcttcacgtttcatatcgcgtaatttcttaggaataatgcggcaatttgattgtgcgcaattttgtagcatttctccagcactctggagaaataggcaagacattggcagaaatgagcattgagagccagggcgctggcgatcacaatgaaaaacatcaggcagatcgttctctgccctcatattggcccagcaaagggagcaagtaatgaacaactttaatctgcacaccccaacccgcattctgtttggtaaaggcgcaatcgctggtttacgcgaacaaattcctcacgatgctcgcgtattgattacctacggcggcggcagcgtgaaaaaaaccggcgttctcgatcaagttctggatgccctgaaaggcatggacgtgctggaatttggcggtattgagccaaacccggcttatgaaacgctgatgaacgccgtgaaactggttcgcgaacagaaagtgactttcctgctggcggttggcggcggttctgtactggacggcaccaaatttatcgccgcagcggctaactatccggaaaatatcgatccgtggcacattctgcaaacgggcggtaaagagattaaaagcgccatcccgatgggctgtgtgctgacgctgccagcaaccggttcagaatccaacgcaggcgcggtgatctcccgtaaaaccacaggcgacaagcaggcgttccattctgcccatgttcagccggtatttgccgtgctcgatccggtttatacctacaccctgccgccgcgtcaggtggctaacggcgtagtggacgcctttgtacacaccgtggaacagtatgttaccaaaccggttgatgccaaaattcaggaccgtttcgcagaaggcattttgctgacgctaatcgaagatggtccgaaagccctgaaagagccagaaaactacgatgtgcgcgccaacgtcatgtgggcggcgactcaggcgctgaacggtttgattggcgctggcgtaccgcaggactgggcaacgcatatgctgggccacgaactgactgcgatgcacggtctggatcacgcgcaaacactggctatcgtcctgcctgcactgtggaatgaaaaacgcgataccaagcgcgctaagctgctgcaatatgctgaacgcgtctggaacatcactgaaggttccgatgatgagcgtattgacgccgcgattgccgcaacccgcaatttctttgagcaattaggcgtgccgacccacctctccgactacggtctggacggcagctccatcccggctttgctgaaaaaactggaagagcacggcatgacccaactgggcgaaaatcatgacattacgttggatgtcagccgccgtatatacgaagccgcccgctaagctttttacgcctcaaactttcgttttcgggcatttcgtccagacttaagttcacaacacctcaccggagcctgctccggtgagttcatataaaggaggaacgtatggctaatccaaccgttattaagctacaggatggcaatgtcatgccccagctgggactgggcgtctggcaagcaagtaatgaggaagtaatcaccgccattcaaaaagcgttagaagtgggttatcgctcgattgataccgccgcggcctacaagaacgaagaaggtgtcggcaaagccctgaaaaatgcctcagtcaacagagaagaactgttcatcaccactaagctgtggaacgacgaccacaagcgcccccgcgaagccctgctcgacagcctgaaaaaactccagcttgattatatcgacctctacttaatgcactggcccgttcccgctatcgaccattatgtcgaagcatggaaaggcatgatcgaattgcaaaaagagggattaatcaaaagcatcggcgtgtgcaacttccagatccatcacctgcaacgcctgattgatgaaactggcgtgacgcctgtgataaaccagatcgaacttcatccgctgatgcaacaacgccagctacacgcctggaacgcgacacacaaaatccagaccgaatcctggagcccattagcgcaaggagggaaaggcgttttcgatcagaaagtcattcgcgatctggcagataaatacggcaaaaccccggcgcagattgttatccgctggcatctggatagcggcctggtggtgatcccgaaatcggtcacaccttcacgtattgccgaaaactttgatgtctgggatttccgtctcgacaaagacgaactcggcgaaattgcaaaactcgatcagggcaagcgtctcggtcccgatcctgaccagttcggcggctaacatgcaaattctcccggtggcggtaatgttccgctaccggacttttcagaaatcatttattcccctcgcgtcccgcccgttgttactcttccttgttcaggaatgccaaatataaggacatcatcatgcagagccggaagctcttaaaagaacaactcatctatatccgggataaacgcaacggagaggtgaaaaacagatgaaaataatacttctgtttttagcagccctggcaagttttaccgtacacgcacagcccccctcacagaccgtagaacaaacagtccggcatatttatcagaactataaatcagatgccactgccccttattttggtgaaaccggagagcgggcgataacttctgcgcgtattcaacaggcgcttaccctgaacgacaatcttacgctgccgggcaatattggctggctggattatgatccggtttgtgattgtcaggattttggcgatctggtgctagaaagcgttgcgataacccaaactgacgccgatcatgccgatgccgttgtgcgctttcgtatctttaaagatgataaagaaaagaccacgcagacactgaaaatggtggcggaaaatggtcgttgggtcattgacgatattgtcagcaatcatggcagcgtcttacaagcagttaatagcgagaatgaaaaaacgctggccgctttagcttcgttgcaaaaagaacagccggaagcctttgttgccgaactctttgaacatattgctgattatagctggccgtggacgtgggtggtttccgactcttaccgccaggcggttaatgccttctataaaaccaccttcaagacggccaataatcccgatgaagatatgcaaatagaacggcaatttatttacgacaatccgatctgttttggcgaagagtcgctattttcacgcgttgatgaaattcgagtcctggagaaaaccgccgattccgcccgcattcatgttcgttttacgctgaccaatggcaacaacgaagagcaagaactggttttacagcggcgcgaaggcaagtgggaaatcgctgattttatccgcccgaacagcggcagcctacttaagcagattgaggcaaaaactgccgccagattaaagcaatgagctgaattaaataacaattagccggaacaataaataaaagggaacactatatgaaaacgattttcaccgtgggagctgttgttctggcaacctgcttgctcagtggctgcgtcaatgagcaaaaggtcaatcagctggcgagcaatgtgcaaacattaaatgccaaaatcgcccggcttgagcaggatatgaaagcactacgcccacaaatctatgctgccaaatccgaagctaacagagccaatacgcgtcttgatgctcaggactattttgattgcctgcgctgcttgcgtatgtacgcagaatgataaaaaaatccccggtagcgtgtcagttgccggggatattttttaacgtccaaccgccgctttaggccgtttcttcgcaccagcattcaccggacgagattgcgtagacgacgctttttttgccgtagcaggcgtctgacgctgggtcgccatcggcgtatgtttcgtcaacgccggacgggtattgcggttctggcgacgagcttcacgcatctcttcaatggttggcgcaggcactaagcaatcgcgacggctgccaatcagatgctttttgcccatcgcttccagcgcctggcggattaacggccagtttgccggatcgtggtaacgcaacaacgctttatgcaaacgacgctgtttgtcgcccttcggtacgaagacgtcttcgctcttataaccaatcttcgccagcgggtttttcccggtgtaatacatggtggttgagttcgccagcggcgacggatagaagttctgcacctggtcgaggcggaagcggtgctttttcagccacagcgccagattcaccatatcttcatcacgcgtaccggggtgcgcggagatgaaataggggatcagatactgctctttacctgcctgttttgagtaagtatcgaacagctctttaaagcggtcatagctgcccatgcccggcttcatcatcttcgataacggcccttcttcggtatgttccggggcaatcttcagataaccgccgacgtgatgggtcgccagttctttgatatagcgcggatcttctacggctatgtcataacgcacaccagaggcaatcaggatctttttaatgcctttcagatcacgcgcacggcgatagaggttgatcgttggttcgtggttcgtgtccatgtgcggacaaatatccggataaacgcacgacaaacggcgacaagtttgttcagcgcgtggcgatttgcagcgcaacatatacatgttggcagttggcccaccaagatcggaaatcacgcccgtaaaacctggaacggtgtcgcggatcgcttcgatctcattaatgatcgaatcttcggaacggctctgaataatgcgcccttcgtgctcggtgatagaacagaaagagcagccgccaaagcagccacgcataatgttgaccgaaaaacggatcatttcgtaagccggaatacgggcattgccataggccggatgtggcacgcgcttgtatggcagcgcaaaaacgctgtccatctcttcggtagaaagcggaatagcaggcgggttgatccacacatagcggtcgccgtgtttttgcatcaatgcgcgggcacagcctgggttggtttcgtggtgcagaatacgcgaagcatgggcgtacagcactttatcgcccttcactttctcgaaagaaggcagcaacacgtaggttttttcccacggtttcgggcgcggtggctgcacggttacggctttggcttcctgctttttcggtgccaccggtttgttatccgcgcacggcaaatcttcaccatacggatgcgggattgggtcgatttttccaggggtatcaagacgggtggaatccacgccgctccagccaggcagcgcctctttcacgataatcgcggtattacgcacatcgcggatttcactaattggctcgcccatcgccagacgatgcgccacttccaccagcggacgctcaccgttaccaaacatcagcatgtcggctttcgaatccaccagcacggaacggcgcacggtatcggaccagtaatcataatgcgcggtacggcgcagactagcctcaataccgccgaggatcaccggtacatctttccacgcctctttacaacgctgggtataaaccagtgtggcgcgatccgggcgcttacccgcgacgttatccggcgtgtaggcatcgtcatgacgtaaacggcgatcggcggtataacggttgatcatcgaatccatgttgccagcagtaacaccgaaaaacagattcggtttacccagacgcataaagtcgtctttgctgctccagtccggctgggcgatgatcccgacgcgaaagccctgcgcttccagcatacgaccgcaaatcgccatcccgaagcttgggtgatcgacatacgcgtcgccagtaaccaaaatgatgtcgcagctatcccagccaagttgatccatctcttcacgagacatcggcaaaaacggtgccggtccaaaacaggcggcccagtactgcggccaggagaacaggtcgcgatccggttggatcagggagatagagctcattttgcttccagaaatgataaaaaaataatcaaaggccggggattataagccggaacgaaagagaaatcgaaaggtattccatactcgccctcctcgggcgagtatgaagattacggtaccggattgaccaacagttgcccaatcgagccacggtccgccatttccagcgtctgactgttgaagtagaacgggaagtgcgcccaggaaggctgaccgaaataaacaagcagctccacttgtccgtcaacccaaacggtatctttccagcctctgtcttccgggaacggcatcgcgccattcacgttacggatctggaacattacgccttcaatatggaacgcttgcggctcgtccgcgcgtaccgtccagcgttcccacgttccttgctgcgcggtgacatcaatacggttgacgtcccacagctgtccattaatacccgggtcatcacccagactgatatcgcgactgcgaattggcgaaccagccatgatttcagttggcagcaagcgcatcggaagactgtctgtgaccagcggcagaaggccggttgggcgcagcgttagcaccagggtagaaaccagaatactggatggctcaaagaagccacgaatacgatcaacaatgctcgccgcttcgccacaggtgatcgacacttcatcgccgttgctcatatccaccagaatctcgcggcgctcgcccggtgccagcgaaagttgcttcaccgatacaggagcaggcaggaatccctgatcgccagaaatcacatgtaacgggcgaccatcgttcatctgtagttgatagcgacgagagttcgacgcgttcagcagtcgcaagcgcacccagccacgcgagacttcaacgtacgggctttgtacaccgttaaccagcagcgtatcaccaacaaagccgccgcttcccggttcgttgtattctggcgtaccaaagttatccagccgtttatcctggataatgaccggaaaatcatccacaccataatggttggggataggcagcgacttgctgacttcatcttccaccagccacattccggcaaggccgttatagacctgctgagccgtgcggttgggagtattggcgtgataccacagagtagctgcgttctggcgaatgggcagtacgggtgcccagtcagcgtttggcgacatcatccgtgccggaccgcccatcagcgggcctggtacctgtagcccggccaccgtcattgagacattttctgtcaggcggttgctgtaaataagcttaacatcgtcgcccttccagacgcggatagtcggccccaggtaacgaccattgattccccagaccgacgcgcgtgtccctggcgtaaatgaccagtgcgcacgttgtacagtcataaacagcggttgcccacggcgagattcaagtagcggcggaacgggtagcggttgctgttgcccggctgcgctggccttcaggggaacagcgcctgcacaaagtgcaatccccgatgcctgaatgaactgacgccgactgagtgacatatttgctccatgtaaaactggctaaagtaataccgtgcaggaaagtgttccccgcaaaaatacagattgccgacttaaacttttccggcggcttcgcgttctgcgacttctttatcgagctcggcgattttttgttccattatcgaacgacaatgggcagccagctcacgaacctgatctttgccatactgactgacgtcaattggcggcagcatttcgacaatcaccagaccgttgtgcagtcgattaagattaatcttattcgaagttgtagagacgcacacgggaataatcgggacgcccgccgcaattgccgcgtgaaatgctccagtcttgaacggtagcaggccgcgaccacggctgcgggttccttccgggaacatccagatggaaatacggcgttttttgaagtgattcactacttccgcaatggtgccgtgagctttagtgcgattgtttctgtcgatcaataagttgccggttaaccagtacaactgcccgaagaaggggatccacagcaagctctttttacctaccgtcaccgtcggcggttgcacgatgttcgatgctgtcaccatgtcatagttgttctggtggttagcgatatagatagcattgccgtagctttcagcgtctgtaggtttacggcactcaactttcaggccaaacagcggcgcaagacggccaaacatatgcccaaaggtggccacatgtttcgggttacgcgggctgaaaaggcagtaaatggagccgaatacacagactaagatgctgtaaatcacggtaataataagacgaaagatatatagcataacaccctctgaaggtctgagagactggcattgtacgtcacctgaaatcaggttagggcattgttaaaagccgctctctggaaaagcgtattgttaatcgcaacgcatgaataaacaacggtttcaagggaatttttatcgtttccgggggttgaatacgctgccggatgacgacttaacgtttcatccggcgttccttgcaagcgggaggaaacagcgccctccccggcatattactcttcgctatcaccgctgctggcacggcgaggagagtcgatctcaacacgatcgatacgctgcaaaccgcgcatcaacgtaccgcggcgtccacgttcgccagtgactttctgtaactcttccgggcgcagtttaattttgcgtttcccaacatgaatggtcagcgtgctttgcggcggcagaacgtacaattgcgccagaccatcttctccacgcgcggcttctgccgatggaatgttgataatcttgttgcctttgcccttcgacagctgcggcagatcacttaccgggaacatcaacatacggcctgcctgagtgattgccagcagcatatcggaagcatcttcaatcaccaccggcggcataacatgggcattttccggtaaggtgatcaaagccttacctgcacggttacgcgccaccagatcgttaaaggtgcagacgaaaccgtaacccgcatcggaagccatcagcagtttctgatcgtcgctttccatcagcatatggtcaacggtcgccccaggcggcaacgttaatttgccggtgagcggctcgccctgaccacgcgccgacggcagcgtaatcgggtcaatggcatagctacgaccggtggaatcaacaaacactaccggttggttgctcttacctttcaccgccgctttgaagctatcacccgctttataattcaggcccggcgcgtcgatatcatggcctttagcgctgcgtacccagcccatctgcgacagcacaatggtgacaggttcagacggcagcatgtcgtgctcgctcatcgctttcgcttcttcgcgttcctgcaacggcgaacgacgatcgtcaccgtaggcttgcgcgtctgcctgcagttctttcttcagcaggttattcattttacgctcggaagccaaaatgccctgcaactggtcgcgctctttttccagttcactctgctcaccgcgaatcttcatctcttccagtttggcaagatgacgcagtttcagttcgaggatcgcttccgcctgggtttccgtaaggccaaaccgcgacatcagcgccggtttcggttcatcttcattacgaatgatctcaatcacttcgtcgatattgagaaacgccaccagcaaaccttcgaggatatgcaggcgcttgaggactttctccagacgatagttcagtcggcggcgcacggtatcgcggcggaacaccagccattcggagaggatttccagcaggtttttcaccgccggacgaccatccagaccgatcatattaaggttaatacgatagctcttttccagatcggtggtagcgaagaggtggttcatcacctgatccatatccacgcggttggaacgcggcacaatcaccaggcgggtcgggttctcgtggtcagattcatcgcgcagatcgtcaaccatcggcagctttttgttgcgcatttgcgcagcaatttgctccagtacgcgcgcacctgaaacctgatgcggcaatgcgctgataaccaccgcgccatcttctttcttccacaccgcgcgcatacgcactgaaccacgtccgttctcgtagattttacggatctcggcgcgcgaagtgataatttccgcttcagtcggataatccggcccctgcacgatatccagcagctgatcgagcgtggttttcggctggtcgattaatgcgattgccgcctgagccacttcacgcaggttatgcggtggaatatcggtcgccatgccgacggcaataccggtggtgccgttaagcaaaatgtttggcagacgggcaggtagcattttcggctcctgcaaagtgccgtcgaagtttggcacccagtcagccgtcccctgccccagctcgctcaatagcagctcggaatatttcgacaaccgggattcggtgtaacgcattgccgcgaacgatttcggatcgtccggcgcgccccagttcccctgaccatcaaccagcggataacggtaagagaacggttgcgccatcaggaccatcgcttcataacaggcgctatcgccgtgcggatggtatttacccagtacgtcaccgacggtacgggccgattttttaaatttggcgctggcattcaggcccagttcagacatcgcatacacaatgcggcgctgaacaggtttcagaccatcaccaataaacggcaacgcacggtccatgatcacgtacatggagtagtttaagtaggcgttttccgtaaattcatgtagcgcaaggcgctctgccatatcgctcattaattctgattcctcaacttattcgccagccttcaaaggggcaatattgccggagatactacattatctgccgcgtcgagtcacaggagatcaacgtgaatagcgccgccggacgtgctccgacggcgataaaggcatcaatgtgccttgatatacaactctttgctgtagacataatcctggggattatgcagcggaaaaccgccaacgtagggtttaagcagtttgattaacggctgatagtagataggaatcagcggtgcctgttggttgatgatcacttctgcctgctgatacaacgcattacgctttgtcgcatcagtgatctgcgtggcctggtttagtaaggcgtcatactgcgcatttttccagtgaccgacgttttcttcactatcgcttttgagcgtgttcaggaagctggaagcatcattgtacgtcgcatcccacgactgccgagacagcatgaaatcaccggctcgtcgggcatcaagataggttttccactccattgtgcgcagcgtcacctgtgcacccagccattttttccattcggaagacaacgctatcgcggtcttttcatgcagatcgtacttgttgtagaacagctcaaagcgtagcggatgagaggcgtcgtatcccgcctgtttcagcaaggcttttgccatcgcgacgcgctcactcattggcttttgcagttcatcgaacgtcgtcgcgctaaagccttttacctctggcggcgtcagcgtggttgcgggcgttctcaaccccagtaccttttgcgcaataagctgtcgatcaaccgtaagatatagcgcccgacgcactcgcacatcgttaaatggcggtttctcaaggttgaagttgtaatattcgctgttcagacgcggaataattcgtagctcgccaggcagtgatttttcaatggcgggaatttgctgcgccggaacccaggtgagatcgacctctcccgcgcgatagcggttatagccggtgaccgaattatctagcgccagatactcaacctgttgcaatactgtatgttgcgcatcgcggtactttggatttttgcgtgcagtaatcttttcgttaactacccactgatcaagcacaaaggcaccgttgtaaaccatgttctctggcttactccagctatcgccatgtttagcgatgacatgatgaggaaccgggaacagcgtcggccaggcgagcatcgtcgtgaaccaaggaaccggctgctcaagcgtaacttcaagagtacgatcatccgtcgctttgacacccagcgatgtaacatctgctttacccgcaacaatagctgcggcattgttaatgtgcgcctgtgccagatagccagcaaaagggcttgccgttttcgggtcaaccgcgcgctgccagccgaggacaaaatcctctgccgtcagaggctgaccgtcggaccactgcaaaccgctacgcagatggaaaatatagcgcttgccgccgtccagtatctcccagcgttcagcctgagcgggctgcacctggccttcaccgtccatccataccagaccttcaaacagatccagcacaatctgcgcggcagtattctcctccaccttttgcgggtcgagcgtacctgggtcgctatgattgttgtaacgaaagacttgttgcggggcgagcggtgtgttggcgggaacgtcagcagcgtagagaggagccgcacttaccaggctgaccagccataataaatttcgcgtatacatggtattccttaccggagaaattataagcccaacaacaatacgcctgtggcattgttcgctcaaacttatcgcgagtgatttggctcacactccggtaaagaaaaaagcgagttgcccccgcttttccattaattaacggatttcattcaatagttctggatgcttatccagaacacgtaaaagtttgattgtggaaggatgaggttgggcattgcctttttcgtaacgcgaaaacgcatttacacctcccccaaaaatttcgcttgcctctttttgggtaagagagagcttttttcgaaccttcactataaattcaggtgccactgtttcggcattcaccgaagcccgaaatgcctttacttgcgccatgaaagcatctgactcttctttattcatgatgctctcttcgcaatggacacaatataaaccgtggatacctttcaatactgtttttcgtccacggaaggtgtatggaatatctttaatgccagaaaccatttctccctggtggcaaaccggacatttcatattacttctccttaaacgagacgatcagtacgtcatgaattaccgtaattttaagataaacctggcctgtaacaagcctgggtctgtaaacatcctgccagatagtatgatcagagtaggtggtcatgcttttataaaagtcgctctctgataatccaatgataacattacacataccatcaaaatccaaacctaactcatctgcatttaacagggcactacgtgttgtacgaacttgcccggcattgacaagttttttaacctgactcaaacgtgtatgtggtgtgcgtttttccataacccccgcctccctgttactttagttataacctaaaaggttaattacagcaatgaaaaagcacctaaaaggttagttagatgtacggagatagtgaccacacaaaacgtattctttaaggaaagtgattgaccatataagaaagtggcgcattagtagcgccagtttgaagcaggaatttataagggaagctggagtcaggcatcacgccaacggcacataaacatccgtttccagtcgctgctctgtcaccccttcggcaagattggtgtagtgaaacagaatcggtgctttacgcattttctcgccgcttgcaggcagccagtggcgaatgatgccccataccgtgtgtgaaatatcgtccagctcgccaacgtggcgggccacggcataacgtccaccggtaagttcaccattgctcacaccataacgattatcgggaatcggttcgctaacgctgccgcagatatcaaagcgaaacgcttccggtgcggtggtggcagggtcgtcccaggcgacgccaaaagtctggctttggttaacaggagaaagccccgtctctttacgccacatgataaatttcgccacgctgtagttgagcaattcagggctacagcggtgcggcaacatcgccacaggtattgatgggaaatcgataatgtttacatccagtgtcaggtttgtcattttgcctccctgcgaaattattcccgggaacgcgtcccgggagcggtaacaattacggatttactttgcggatctgtttgacgtcaatttcaacagaattccagtctttatcgacttcaccctgaatctcaaccgtatctttcggcgtcaccgtcacgccgttccagcgtttgtggtcgatatcaacattgatagtaccgctggcatctttgaacacgtagagatcgtcagagatgcgttcaacgatattgccgcgcagggttacccaggtgtcgtcacgcagggattttgcgctttctacagtcgttacgctgccgttcggcccctggaatcctccggcctgactttgcgttgccgatgggccagaaaaaccgccctgctctgctgccatcaccggtgcgctgcacagggccattactgcgattactgctgcgaattttttcatgtttattactccctttaatgtctgtttccgagcatttaacaagatagtccttaacaacttcttaagggaaaaaaataaaatttagtgctgtacagagcgcgttacaacacggtttactggcagcaaatacggttatcgcagggatgaaaaaatgcgaattttactgatagaagatgacatgctgattggcgacggcatcaaaacgggccttagtaaaatgggttttagcgtcgactggtttacacaaggtcgtcagggaaaagaggcgctttatagcgcaccttatgatgcggtgatcctggatttaaccttaccaggcatggatggtcgcgatattttgcgcgaatggcgagaaaaaggtcagcgtgagccggtactgatcctgaccgcgcgcgatgcgctggcggaacgtgtagaagggctgcgtctgggagctgacgattatctgtgtaaaccttttgcgttgatagaagtcgccgccaggctggaagctctgatgcgccgaaccaacggccaggccagcaacgagctgcgccacggtaacgtcatgctcgaccccggcaaacgtatcgccacgctggctggcgaacccttaacactgaaaccaaaagaatttgccctgctggaattactgatgcgtaacgctggtcgggtactgtcgcgcaaactgattgaagagaaactgtatacctgggacgaagaggtcaccagtaatgccgttgaagtgcatgtgcatcatctgcgacgcaaactcggtagtgattttattcgtaccgtgcatggtattggttacacattaggtgagaaatgaaatttacccaacgtcttagtctgcgcgtcaggctgacgctaatctttttaattctggcctcggtgacctggctgctttccagctttgtcgcctggaaacaaacaacggataacgtcgatgaattgttcgacacccaactgatgctgtttgccaagcggttaagtacgctcgatctcaacgaaatcaacgcggcggatcgcatggcacagacgccaaatagattaaaacacggtcatgttgatgacgatgcgctgacctttgccatctttacccacgacggcagaatggtccttaatgatggcgataacggagaagatattccctatagctatcaacgggaaggttttgctgacgggcaactggtcggtgaagacgatccttggcgttttgtctggatgacctcacctgatggcaaatatcgcatcgttgttggccaggaatgggaataccgtgaagacatggcgctggcgattgttgccgggcaattgatcccgtggctggtcgcactgccgattatgttaatcatcatgatggtactactgggtcgtgaactcgcgccgctgaacaaactggcgctggcactacgtatgcgtgaccctgactcggaaaaaccactaaacgcgactggcgtacccagcgaagtgcggccactggttgagtcgctaaatcaactgttcgcccgcacacatgcgatgatggttcgtgaacgacgctttacctccgacgcagctcacgaacttcgtagcccgttaacggcgctgaaagtgcaaaccgaagttgcgcagctctctgacgatgatccgcaggcgcggaaaaaagcactgctccaattacattccgggatcgatcgcgctactcgtctggttgatcaactgctcacgctatcgcggctggactcactggataaccttcaggacgtcgcggagatcccgcttgaagatctcctgcaatcgtcggtgatggatatttaccacacggcgcagcaggcgaaaattgacgtgcgactgacactcaatgcccacagcatcaaacgcaccgggcaaccgctattgctaagtttgttggtgcgaaatttgctggataacgccgtgcgctacagtccacagggcagcgtggtagacgtcacgctgaatgctgataatttcatcgtgagggataacggccccggtgtgacaccagaggcactggcgcgaattggcgaacgcttctatcgcccacccggacaaaccgctaccggcagcgggcttgggctatcgattgtccagcgaatcgccaaattgcatggcatgaatgttgaatttgggaatgcggaacaaggtggatttgaggcgaaggtaagctggtaacttctctgtctatgagagccgttaaaacgactctcatagattttactaatagcaaaatataaaccgtccccaaaaaagccaccaaccacaaaccagacaaataccgagcgagaatacatatacccaaaactcgaacatttcccgcataaagagttttcttaagataagaataataagtggcgtaagaagaaaaaatgctgcaatcattgcttgcaatatacgatcttcgcctgaaacggaaggtatactgcaaatatttcctcccgactcaagcatccagtcatacttattgaaagcaaaaaaagaatctattaaccaataagtaagcattatatatagcaatgcttcaaatattgttttaattttctgctttaacatatatcagtacgctcataaaaatccatttataattatcaacatgacacgttgatactttcatcttttacttattcaaagccatattttcaatccccaaaaaaaccgaaccaaacgtgtaaattattccggtgcgagtaagaattatgaggaatggctatcagtattgtcattttcagaaaatatttatcctgcatcggtgagtcagagtaagatcagacttttgctaaattcgcaaaagactttgcacattttgctaatttcaccgtaccgctctgtgacgtactatagtcggcaaacgtctcaccttgaggttaaaaaatgagcaacatcctgattatcaacggcgcgaaaaaattcgcccactccaatggtcaactgaacgacaccctgaccgaagtcgcggatggcacactgcgcgaccttgggcatgatgtccgcatcgttcgcgccgacagcgactacgatgtcaaagcggaagtacaaaactttctctgggctgatgtggtgatctggcagatgccaggctggtggatgggcgcgccgtggacagtgaaaaaatacattgatgatgtattcaccgaaggtcacgggacgctgtatgccagcgatggtcgtacccgcaaagatccgtcgaaaaaatacggttccggcggcctggtacagggcaaaaaatatatgctttctctgacctggaacgcaccaatggaagccttcaccgaaaaagatcagttcttccacggcgttggcgttgacggtgtgtatctgccgttccataaagcaaaccaattcctcggtatggaaccgctgccgacatttatcgctaatgacgtgataaaaatgcctgatgttccccgctatactgaagaatatcgcaagcatcttgtggaaatttttggttaactagagctcaggctttagaaggagttaaccatgcttaccgtaatcgcagaaatccgtactcgtcctggtcaacatcaccgtcaggcggtattggatcagtttgctaaaatcgttccaaccgtactgaaagaagaaggttgccacggctatgcgccaatggtggattgcgcagctggcgtgagtttccagtctatggcaccggattctatcgtgatgattgagcagtgggaaagcatcgcgcatcttgaagcgcatctgcaaaccccgcacatgaaggcgtatagcgaagccgtaaaaggtgacgtgctggagatgaatatccgtattctgcagccagggatttaatcctgccttgtttgcccggccatcctgaccgggcaatgttctttcctttaaacctcaatctccgccatgtcgcctttctcttgcaaccagttgcggcgatcttccgagcgtttcttcgccagcagcatatccatcatcgcgtcagtacgctgatcgtcttcatcatcgatagtcaactgcaccagacggcgagtgttcggatcaagcgtggtttcgcgcaattgcatcgggttcatttcccccagacctttaaaacgctggacgttcggcttgcctttcttgcgttttaattgctcaagtacgccctctttctcttcttccgtcagcgcgtaataaacctctttcccgagatcaatacggtagagcggtggcagtgcgacgtaaacgtgaccgtgtttcaccaacgcgcggaaatgttttacgaacaaagcgcagagcagcgtggcaatgtgcagaccatcagagtccgcatccgcgaggatacagattttgccataacgaagctggctcagatcgtcgctgtcaggatcgataccgatcgctaccgaaatatcgtgcacttcctgcgaagccagcacttcgtcggaagagacttcccaggtgttaaggatcttacctttcagtggcatgatcgcctgatattcgcgatcgcgcgcctgcttggcagatccgcctgcggagtcaccttccacaaggaacagctcggtacggttaaggtcctgcgcggtacaatcagccagtttgccaggcaacgccgggccgctggtcagctttttacgcaccacttttttggccgcacgcatacggcgctgggcgctggaaatcgccatctccgccagcagttcagccgcctgaacgttctggttcagccacaggataaaggcatctttcaccacgccagaaacgaatgccgcgcattgacgcgaagagagacgctctttcgtctgcccggcaaactgcggatcctgcatttttactgacagcacataggcgcagcgatcccagatatcttccgccgacagctttacaccgcgcggcagaatattgcggtattcacagaactcacgcatcgcgtccaacaggccctgacgcagaccattaacatgggtaccgccctgcatcgttgggataaggttgacgtagctttcggtcagcagttcaccgccttccggcagccacagtagcgcccagtccacagcttcagtatcaccagcgaaattaccgataaacggtttttccggcagcgtcggcagaccatttaccgcttccgccaggtaatcattcagaccgtcctgatagcaccagcgttgttcggtattgttgatctcatctttaaaagtgatctcaacgccagggcacaataccgctttggctttcagcacatgcgtcaggcgtgaaacagaaaatcgcgggctgtcaaagaaggtttcatccggccagaagtgcacactggtaccagtattgcgtttaccgcaagtgccgacaacctgtaaatcctgcaccttttcgccattttcaaaggcgatgttataaacctgaccatcgcggcgcacgttaacttctacgcgcttcgacagggcgttaaccaccgaaatccccacgccatgcaggccgccagagaactggtaatttttgttagagaatttaccgcctgcatgcagacggcaaagaatcagttcaaccgccggtacaccctcttccgggtgaatatccaccggcatcccgcgcccatcgtcaataacttctaacgactggtcagcatgtaaaataacgtccacgcgttttgcgtgacccgccagtgcttcatccacactgttatcaatgacttcttgccccaaatggttagggcgagtggtatcggtatacatccccggacggcggcgaaccggctcaagcccggtgagtacctcaatggcatcagcgttataagtttgcgtcatggtttaagttagtaattcgagttgatcgtcagagatggtgcagaccaagaaaatcgacgatcgggttgaaataatcttcgaagcccgtgaatgcgtggttgccgccttctatgacagtctggcggcaggaagcgtagtacgccaccgcctggcggtaatccagcacttcatctcccgtctgttgcagcagccagatcaaatccggcgcttccagcgggtcaatctgcatgactttaagatcgtaaatatggcgtgactctagcacatattgctgcccggtgtaggggttctcgttctgaccgagatagtccgtcagcagttcaaacgggcgcaccgccgggtttaccaccactgcgggcagcataaaacattgtgacaaccaggtggcgtaatatccccccagtgacgaaccgacaatacccagcgaatcaccgccatgttccaggacaatggattccagcagctctgccgcgtcggaaggatacggcggcaactgcggaatgatcatctcaacgtcagggtgatgttccgccagccagttttttaacaagctcgcttttgcagagcgcggcgagctgttgaaaccgtgtaaataaagaagcgtagacatcagtagccttctgaagcggtatcaggttggaaacgtgtgtccgccaggcgatgcacctcggtggtcagcgtgccatcagcatgtaactcgagagtacgccagccgggcgcgatggtatccagcgtaaagttggaacagtgcggcttaaactgcacacaggtcgacggcgttgccagcaggcggcgaccattccagtcgagatccagctcctgatgaatatgaccgcacagcaagtatttgacgtgcggaaacttcgccagcacggtatccagttcgcccgcgttacgcagactgtgttgatcgagccaactacaacccgcaggtagcggatgatgatgcagcagcagcaacgtatggcgttctggcgcatcggccagtttacgttccagccactcaagctgaaactcgctcagctcaccgtgcggcacgccaaacacctggctatccagcaacaggatttgccattgctcaccaataaacacgcgcttcgccggggagatacccgcatcctgtaacgcgctgtacatcgcgggctggaaatcgtggttgcccggcagccagacgcagggcgcacgaaaacttgcgatgccttcagcgaaatgctgataggccgcagaggattgatcctgcgctaaatcacctgtcgcgacaatcaggtcgaattcgtgctggtgtggccgaatcgcctccagcaccgcctggtaactctcccaggtgtttacccctaacagggcttcgtgcttttgtgcaaacaggtgagtgtcggtaatttgtaaaatcctgactctggcctcaccagccagaggaagggttaacaggctttccaaatggtgtccttaggtttcacgacgctaataaaccggaatcgccatcgctccatgtgctaaacagtatcgcaaccagtccgctaaaaactgattaatttgatgcttttcgtcgcgttgatgcaactttttattaggataatcataccgcgctttgaagcgaaaaatctgctggcttgaacacacttcagccaccatcgcgtcatgatacagacgcaccgtcattgacggaaggctccagtaactgatcgcgggcgcagtctgttctattgtcaccagggtagtgtatcgggtcgattccacaatcgtcagccgatattgtgcgtttgccacctgatagcttacagtttcgccgggtgcgtcattgcgcggtaacaaacggcgcaattgtgaaaagttcatctcgcacaggcgcatcatttcaggaaagtcaggtgtgtaacgcttcatttatgcccactcattttttaacgcttgatgatgcagctgcagccattgcaaagcgatgaccgacgctgcgttgtcgattttcccctcttctacccactggtatgcctgttcccggcttaccacatgaacgcgaatatcttcgttttcatcagccagaccgtgaataccgcttgcggtcgtggcgtccacttcgcccaccataattgacgaacgctcactggtgccccccgggcttgccaggaaacttaacaccggtttggtccgtttgactatcagtcccgcctcttcaatcgcttcgcgacgggcaacatcttccacactttcaccctcttcaatcatcccggcaaccatctccagtagccaaggggtttcgctggtgtcgtacgcggcaatccgaatctgctcaatcagcacaacttcatcacgcactgggtcaaagggtagcaagactgcggcgtgaccgcgctcaaaaatttcccgccgcacctcatgactcatttgcccgttgaatagacgatgacgaaatctataaagatctaatgaaaaaaagccgcgataaagtgtttctcgtgcaataatttctacatcgtttttgccaaatgtaacgggcaggttgtctggcttaagcattgttaatgtcctggcactaatagtgaattaaatgtgaatttcagcgacgtttgactgccgtttgagcagtcatgtgttaaattgaggcacattaacgccctatggcacgtaacgccaaccttttgcggtagcggcttctgctagaatccgcaataattttacagtttgatcgcgctaaatactgcttcaccacaaggaatgcaaatgaagaaattgctccccattcttatcggcctgagcctttctgggttcagttcgttgagccaggccgagaacctgatgcaagtttatcagcaagcacgccttagtaacccggaattgcgtaagtctgccgccgatcgtgatgctgcctttgaaaaaattaatgaagcgcgcagtccattactgccacagctaggtttaggtgcagattacacctatagcaacggctaccgcgacgcgaacggcatcaactctaacgcgaccagtgcgtccttgcagttaactcaatccatttttgatatgtcgaaatggcgtgcgttaacgctgcaggaaaaagcagcagggattcaggacgtcacgtatcagaccgatcagcaaaccttgatcctcaacaccgcgaccgcttatttcaacgtgttgaatgctattgacgttctttcctatacacaggcacaaaaagaagcgatctaccgtcaattagatcaaaccacccaacgttttaacgtgggcctggtagcgatcaccgacgtgcagaacgcccgcgcacagtacgataccgtgctggcgaacgaagtgaccgcacgtaataaccttgataacgcggtagagcagctgcgccagatcaccggtaactactatccggaactggctgcgctgaatgtcgaaaactttaaaaccgacaaaccacagccggttaacgcgctgctgaaagaagccgaaaaacgcaacctgtcgctgttacaggcacgcttgagccaggacctggcgcgcgagcaaattcgccaggcgcaggatggtcacttaccgactctggatttaacggcttctaccgggatttctgacacctcttatagcggttcgaaaacccgtggtgccgctggtacccagtatgacgatagcaatatgggccagaacaaagttggcctgagcttctcgctgccgatttatcagggcggaatggttaactcgcaggtgaaacaggcacagtacaactttgtcggtgccagcgagcaactggaaagtgcccatcgtagcgtcgtgcagaccgtgcgttcctccttcaacaacattaatgcatctatcagtagcattaacgcctacaaacaagccgtagtttccgctcaaagctcattagacgcgatggaagcgggctactcggtcggtacgcgtaccattgttgatgtgttggatgcgaccaccacgttgtacaacgccaagcaagagctggcgaatgcgcgttataactacctgattaatcagctgaatattaagtcagctctgggtacgttgaacgagcaggatctgctggcactgaacaatgcgctgagcaaaccggtttccactaatccggaaaacgttgcaccgcaaacgccggaacagaatgctattgctgatggttatgcgcctgatagcccggcaccagtcgttcagcaaacatccgcacgcactaccaccagtaacggtcataaccctttccgtaactgatgacgacgacggggcttcggccccgtctgaacgtaaggcaacgtaaagatacgggttatctgccgcattcttcccccttctcgcttcaatttcgaccagccatcctctattctgatgggtatttaccactggtcccggaagacaaaaatgaaacggacaaaatccatacgccacgcatcgttccgcaaaaactggagcgcacgccatctgacaccagtcgctctcgcggttgccactgtttttatgctggctggctgtgaaaagagtgatgaaacagtgtctctctatcaaaatgctgacgactgttcagctgcaaacccaggcaaaagcgccgaatgtaccaccgcgtacaacaatgcgctgaaagaagccgaacgtactgcgccgaaatacgccacccgtgaagactgtgttgctgaatttggtgaaggtcagtgccagcaggcaccagcccaggctggcatggcaccagaaaaccaggcgcaggcccagcaatccagcgggagtttctggatgccgctgatggccggttacatgatggggcgtctgatgggcggcggcgcgggatttgcacagcagccgctgttctcctcgaaaaacccagccagtccggcttacggtaaatataccgacgcgacgggtaaaaactatggcgcagcccagccaggccgcaccatgaccgtaccgaagacggcaatggcaccaaaaccggcgaccaccactaccgttacccgtggcggttttggtgaatctgttgccaaacaaagcactatgcagcgtagtgcaaccggtacctcttctcgttcaatgggtggctgataccgatggaaagagtcagtattaccgagcgcccggactggcgtgagaaagcccacgaatacggtttcaattttcacaccatgtacggcgagccgtactggtgtgaagatgcttactacaagttgaccctcgcccaggttgaaaagctggaagaagtcaccgccgaactgcaccagatgtgcctgaaagtggtggaaaaagtgatcgccagcgatgagctgatgaccaaattccgcattccaaaacacacctggagttttgtgcgccagtcatggctgacgcaccagccatcgctttattcgcgtcttgatctggcgtgggatggcactggtgaacctaaacttctggaaaataacgccgatacgccaacgtcactatacgaggcggcgttctttcagtggatctggctggaagatcagcttaacgccggtaacttgccggagggcagcgaccagtttaacagtctgcaagaaaaactgatcgatcgcttcgttgagctgcgtgaacagtatggcttccagttgctgcatctcacctgctgtcgcgacacggtggaagatcgcggaaccattcagtatttgcaggactgcgcaacggaagctgaaattgctactgagttcctctacatcgatgatatcgggttaggtgaaaaaggtcagttcacggatttacaggatcaggtaatttccaacctgttcaaactgtatccgtgggaatttatgttgcgtgagatgttctcaaccaagctggaggatgcaggcgtacgctggctggaaccggcgtggaagagcattatctccaacaaggcacttctaccgctactgtgggagatgttcccgaatcacccgaacctgctgcccgcttattttgcggaagatgatcatccgcaaatggaaaaatatgtggttaaaccgatcttctcccgtgaaggcgcaaacgtgtcgatcattgagaacggcaaaaccattgaagcagcggaaggtccgtatggcgaagaagggatgattgttcagcaattccacccgttaccgaaattcggcgacagctatatgctgattggtagctggctggtgaacgatcaacccgccggaattggcattcgtgaagaccgtgcattgatcacccaggatatgtctcggttttatccacatatttttgttgaataagccacgataccggatggcactcgccatccggtaattgttagcctatctgcaccgacagcatactcaggctgcccatttctataccctcaaccggaatggtaattggctcctgcccatcccacgcacctaacacatacaacaacggcaaataatgctctggcgttgggttcgataacgtgccaccttcatggtcgaggtaattcaccagaggatgttgttccactggcccttgccacgtcagattcgctttcacatactcattaaacgacgtcgcccacggatacggtgaactatcaccgtgccacttcactgtgcgcaggttatgcaccacgttaccgctggcgaccaacattattccttcatctcgcagcgctgccagtttgcgccccatttcgaaatgccaggcggcaggtttgctactgtcgatactcaactgcaccatcgggatatcagcgtcaggatacatcttaatcagcacgccccacgagccgtggtcaaagccccaggcttctttatccagcgtcaccgggatcggcgctaacagctcaaccagacgctgtgccagcgcaggcgaacccggagcaggataatgcgtatcgtacagcgcctgcgggaagccaccaaagtcatgaatcgtgggcggcgtctccatcgcggtcactcctgttccacgggtaaaccagtgagccgaaaccaccacaatcgcttgcgggcgtggcaatgtcatccccaacttctgccagctgcgggtatacaaattatcttccagcacgttcatcggactaccgtgacctaaaaacaatgctggcatacgtgttgaagacatgatgatatccttaactaaaggtgtcattttgatatcctcacaatacgcttgttcggcggagtaagaacccggataacaatgatgatgatcatcagttattttgacgatctgcctgaaggtgaagatttataaggagttgtcgatgtcagtacctctcattctgaccatactggcgggggcagccacgtttattggcgcgtttctcggcgttctcgggcaaaaaccctcgaaccgcttactggcgttttcgctaggttttgcggcggggatcatgttgctcatctcattaatggaaatgcttcctgccgcactagcagctgaaggaatgtcgcctgtgttgggttatggaatgtttatcttcggtctgcttggctattttggcctggaccgcatgttgccacatgctcatccgcaggatttaatgcaaaaatcggtgcagccgttgccaaaatcgatcaagcgcacagccattctgctcactctcggcatcagtctgcataacttcccggaagggattgccacctttgtcacggcgagcagcaacctggagctgggatttggcatcgcactggccgtcgcgttgcacaatatccctgaaggtctggcagtggcaggcccggtttatgcggcaacggggtctaaacgcaccgcgattctgtgggcggggatttctggactagcagaaattcttggtggtgtgctggcgtggttaatcctcggtagcatgatttccccggtggtcatggcggcaatcatggcggcggttgcaggaattatggtggcgctctcggttgatgaattaatgccgctcgccaaagagattgaccctaataataaccccagctatggcgtactatgtggaatgtcagtgatgggattcagtttagtgctgctacaaacggcgggaattggttaaaaacaacatcagaagttgtccagcgcatggacaacttctgccagcttcacgaaagccttattctaccttttcggctgtctcttctctcgtactgtttaagtatttgttccgcgcttcaagcagtgcgtctctgtcctggcgaaacgcccgacaataacgtttcaaatgcaggaaataacccaccacaaccagagcaatcaatacaatccagtaccaggcgataaacatccttttacccttaatatttaacaatactaaacatttagcgtataaatttcacatatcctttttcggatatattcatatggtcgcataataacggaacaattatatgattttgatcataatgaaaaagaatgcctgatattaatgaaattttctcatagaaagagaagcggaattaacatcttgcatagcagggaaaaataaaaaccgaagcctgctacaacttcggtttcttgattaaggcagtaaattaagcagcggttttcagctggctttacgctcatgtgcctgacggtatgccaccaggtcttcaatagtcacgagcgccatattgtgtttattggcaaactcaatacactctggtgcacgcgccatcgtgccatcgtcattagtcagctcacacagtacaccagccggtttaaagcctgccagcgtcatcagatcaatagttgcttcagtatgaccgccacgcgtcagtacaccacctgcctgagcgcgaagtgggaaaacgtggccaggacgattcagatctgacggttttgcgccatcggcaatcgctgcgcgaacggtcgtaatacggtcagcggcagaaacaccggtagtcacaccttcagctgcttcaatggtcacggtaaaaccggtgccataggcgctggtgttattttctaccatcattggcagatcgagttgtttacggcgatcttcagtaatgcacaggcaaacaataccgctaccgtggcgaatggtcagcgccatctgctcaacagtcatggtttctgccgggaagatcatatcaccttcgttttcacggtcttcatcatcaagcaccattacaccgcgtccttcacgcagcgcagccagtgcattttcaacacgttcgaaaggcgtaccaaaagaggaaagtagcgtctgattcatggtaaaaaaacctcactaaaattatggttaccagaatcagggcagtcttaggagtggcggcatatagccaaaataacgtgagcgggtccatgcccgacagaatcgttactctctcccatccggactctaaccgtcggccccggaattacaccggatctgctgtcctttgagttcgcacccaaagcgctcgcgggctttcaactgagttgatttaccgccggtggggaatttcgccccgccctgagaataagcggattcactataacgctaatgattagcggcagcaacgcatagcttcacataattctggtttatgacttacccttatcgcactacaatggcactcaacacctatcagtacagggaaactacaatgattgacccgaaaaaaattgagcaaatcgctcgccaggttcacgaatcaatgcctaaaggaatcagggagttcggggaagatgtggagaaaaaaatccgccaaaccctacaagcgcagctgacgcgcctcgaccttgtaagccgtgaagagttcgacgtccaaacgcaagtcctgttacggactcgtgaaaaactggcgctgcttgaacaaagaatcagcgaactggaaaatcgcagtactgagatcaaaaagcagccagatccagagactctccccccaacgctgtaaacattcgtctttaatgcactgtaaattatgaattaatcctctaatttatagtgctttctattaccttatcgcgtaatcccattcagaaaaccatcacaaaaatgaatgagtacaattgaaagtataattgcaatgtattttttaagttttacttaatcgatatttagataaactaattttataaaaaacacaaaataaaatatcatatttcaatgattagtagtccttaaataacagttactaatcattctcttttctacttatctttatataaaggaatattatgtccgcttttaaaaagtcacttcttgttgctggcgtagcaatgattctttccaataacgtgtttgctgatgaaggtcacggtattgttaaatttaaaggtgaagttatctctgctccatgttctattaaaccaggtgacgaagatttaactgtaaatctgggtgaagtagcagataccgtactgaaaagcgatcagaaatctttggctgaacctttcactattcacctgcaggactgcatgctgagtcagggtggaactacttattcaaaagcgaaggttactttcactacagcaaataccatgacgggtcagtctgatcttctgaaaaataccaaagaaactgaaatcggcggcgccactggcgttggcgtacgtattctggacagccagagcggcgaagtaactttaggtactccggtagtaattacgttcaacaataccaacagctatcaggaactgaatttcaaagctcgtatggaatccccaagcaaagatgccaccccgggcaacgtttacgctcaggctgactacaagattgcttacgagtaatcgcatttggccgggttcgcccggccacatcattaacggattaatgataagtggatcagatgtataaaaaattaaaattaaccacaataagcgaattgattaaaaatatttattgttcattatccgttattagactggccccctgaatctccagacaaccaatatcacttaaataagtgatagtcttaatactagtttttagactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccagttatcatcattggttgtgcgtcagcttatgccgttgaattcaacaaagatttaatcgaagccgaagatcgtgaaaacgttaacctttcccaatttgaaactgatggccaattacccgtcggcaaatattcactaagcactctgattaataataagaggacgccaatccaccttgacctccaatgggtattaattgataaccaaactgcagtttgcgtgacaccagagcaattaacattattaggatttactgatgaatttattgaaaaaactcagcaaaacctgatcgatggttgttaccctatcgaaaaagaaaaacaaattacaacttatctcgataaagggaaaatgcaattatccatatctgcacctcaggcatggttaaaatacaaagatgcaaactggacgcctcctgaactttggaatcatggtattgctggggcatttcttgactacaatttatatgcctctcattatgcaccacatcagggcgataattcgcaaaatataagttcctatgggcaggctggggttaatcttggggcctggcgcctgcgtactgattaccagtacgatcagtcatttaacaatggcaaaagccaggcgaccaacctggattttccgcgtatttatttgtttcgcccaatcccagcaatgaatgcaaaactaactataggtcaatacgatactgaatcctctattttcgactctttccatttttctggcatttcgttgaaaagcgatgagaatatgttaccgccagacctacgtggttacgcaccgcaaatcacgggtgtcgcacaaacgaatgcaaaggtcactgtctcacagaacaaccgtattatttatcaagaaaatgttcctccaggcccatttgctattaccaatttattcaatacattacaggggcaacttgacgtcaaggttgaagaagaggacggacgcgttacgcaatggcaagttgcatctaatagtattccttatctgacgcgtaaagggcagattcgctacaccactgctatgggtaaaccgaccagcgttggtggtgattccttacaacaacccttcttctggactggtgaattctcatggggttggctgaacaatgtatccctgtatggtggttcagttttaacaaaccgtgattatcaatctctggctgccggcgttggttttaatcttaactcattaggttcattatcttttgatgtcacacgatctgatgctcagttgcataatcaggataaagaaacgggttatagctaccgcgctaactattcaaaacgttttgaatctaccggtagccagctcactttcgctggttaccgtttctctgataaaaactttgtgacaatgaatgaatatatcaatgacactaaccattacacgaattatcagaatgaaaaagagagttatattgtcacgtttaaccagtatcttgaatcattaaggttaaatacatacgtaagtttggctcgtaatacttactgggacgccagcagtaatgtgaattattcattatcacttagccgcgattttgatatcgggccattaaaaaacgtctccacttctctaacatttagccgaataaactgggaagaagacaaccaggatcaactgtacctaaatatttcgattccctggggaactagtagaacattgagctatggtatgcaacgaaatcaggataatgagatttcgcatactgcttcgtggtatgactcttccgatcgaaataattcctggagcgtttctgcttcaggcgacaatgatgaattcaaagatatgaaagcgtcactacgcgccagttatcagcataataccgagaacggtcgactctacctctccggtacatcacagcgagacagttattattctctgaatgccagttggaatggttcattcactgcgactcgccacggtgccgctttccacgactatagcggtagtgctgactcgcgttttatgatcgacgcagacggcactgaagatattccgttgaacaataaacgcgcggtaactaatcggtatggcatcggagttattccatcagtcagcagttacataacaacatcattaagtgttgatacccgaaatctgccagaaaatgtggatatcgaaaactcggttatcaccaccaccttaaccgagggtgctattggctacgccaaacttgatacccgcaagggctaccaaatcataggggttattcgcctggcagatggtagtcatccaccactggggattagcgtaaaagatgaaaccagccacaaagaattaggactggttgctgatggcggctttgtatacctcaacggcattcaggatgataacaaacttgctttacgctggggtgacaaatcttgttttattcaaccacccaatagcagcaacttaaccaccggaacggctattttaccgtgtattagccaaaattaattcaggatgaaactaatgcgctacttaaatacaaagaatatcattgcagcaggagtattactctcctgtatgagcagcattgcctggggtgccatcatcccggatcgtacccgtatcataatgaatgagtcagataaaggcgaagcattaaaacttactaatcaaagtaaaaacctgccctatctggcccaaacatggatagaagatacgaaaggcaataaatcgcgtgactttattgtcactgttcctccaatggtgcgtttaaatcccagtgagcaaattcaaataagaatgataactcaggaaaaaattgctcaacttcctaaagacagagaaacgctcttctattttaacgtgcgagaaataccgcccaaaacagataaaaaaaatgtgatgcaagtcactatgcagcacgcattgaaactattctggcggccaaaagccattgaattagaagacgatggggtaatgacttacgaaaaagttgaaatcattcgtagaaatgacggttcgatccgctttaacaataagatgccttatcacgttacgctgggttatatcggaacaaatggggtaacgatgttaccacaaacgcaaagcttaatggtaaccccttttagctatgcaaatacgcagtttaaaaatgttccgtcaacttttcaggtgggttatatcaatgactttggtggattaagtttttatgaaataaactgccctgtagtaaataacatttgtaatatttctgtagccaaccgagatcaataatatgcgctacttgttaattgttattactttttttatgggttttagttcattacctgcatgggcaatggactgctatgctgaacatgaaggtggaaataccgttgtcattggttacgtaccaagaatctctatccccagcgatggtaaaaaaggtgataaaatctggcaaagcagtgaatattttatgaatgttttctgtaataatgcactaccaggcccatctccaggagaagaatacccatctgcatgggcaaatataatgatgttgttagcatcaggtcaagacttttataatcaaaactcttatactttcggtgtaacttataatggggttgattatgattctacatctccactacctattgcagcacctgtatgtattgatataaagggagccggaaccttcgggaatggctacaaaaagcccgcagtctgtagtggcggtcctgaaccgcaattatcagtaacttttccagtacgagtgcagctatatattaagctagctaaaaatgccaataaagtaaataaaaaacttgtattacctgacgaatatatagcacttgaatttaaaggtatgagcggagcaggtgctatagaagtagataaaaatctgaccttcaggattcgcggattaaataacattcatgtccttgactgctttgttaatgttgatctggaaccagctgatggcgttgtcgactttggtaaaataaattcccgaacaattaaaaataccagcgtgagtgagacgtttagcgtagtcatgaccaaagatccgggtgcggcctgtactgagcagtttaatattttagggagttttttcactacggatattttgagtgattatagccatctggatataggtaatggtctgctattgaagatatttcataacgatggaacagcaacggaatttaaccgcttctcacaatttgcttctttttcatcgtctagtgcgccttcggtcaccgcaccattcagggcagaactgagtgcgaacccggcagaaacggttgttgagggaccgtttagtaaagacgtaatcctgaaaatcacctataactagtatctaatacaaacactaaaacgggccatcaggcccgttatatcagtgctctaactccagctctcttgcctgcatcatctgttgacaataccaggcataacgtgcgcaaaaccaggttctatgttcttcatccatgttaccagtaacggccagaatatcgaccgggcgaccttctgcgtgcattctggcaaaactacgcgccaggaaatcgaaattatttaaagaattaagactatgatccataagcacatcctccggttatcgcataccttttaaggccatatgctttttctgatttcagtattccccaatcagtgtagtgcctttaaacataacgtgcgtaaatatattgtccccgatcacactttttagtgaaaaataaaaaaccatattaaaagactttctcttccagaacttctctaacctgtgttattattaacacagataaatgtaagcaaggaaactattacaaagtaaatattgcgtcactaaatggacattggagtgatatatgattttattcgccgactataacaccccttatcttttcgctatttcctttgtactgttgatcggcctgttagaaatttttgcgcttatctgcggtcacatgctctccggtgctcttgatgcacatcttgaccattatgattctataaccacaggtcatattagccaggcacttcattatctcaatattggaagattgccagctctcgtcgttctctgcttactggctggtttttttggtcttattggcatcctgttgcagcatgcctgcatcatggtctggcaatcaccactgtcgaacctgttcgtggttcctgtcagtttactgtttacgattattgcggtgcattataccggtaaaatagttgcgccctggattccacgcgaccatagttcagctattacagaagaagaatatattggtagcatggcgttaattaccggtcatcaagccacttcaggtaatccctgcgaaggaaaactcaccgatcaatttggccaaatacattatttactactggagcctgaagaaggaaaaattttcactaaaggagacaaagtgttaattatttgccgactttctgcaacgcgatatttggcggaaaataatccctggccccaaatattgtaatttattaatcaaaaggaaatttaataatggatgatattgttaattctgtgccctcctggatgtttaccgcaattattgccgtatgcattctgtttattattggaattattttcgccaggctctatcgtcgcgcttcggcagagcaagcttttgttcgtactggtttaggtgggcaaaaagtggtaatgagcggtggcgcaatcgtgatgccgatctttcatgaaataatccccatcaatatgaatactctgaagctggaagtcagccgctcaaccattgatagcctgattacgaaagatcgtatgcgcgtcgatgtagtagtcgctttctttgtgcgggtaaaaccttcagtagaagggattgccaccgctgcccagacgctggggcaacgcaccctgtcgcctgaagacttacgtatgttggttgaagataaatttgtcgatgccctccgtgcaacagctgcgcaaatgaccatgcatgagttacaggatacccgcgagaactttgtgcagggggtgcaaaatacagtggcagaagacctgtcgaaaaacggtctggaactggagagcgtttcacttaccaactttaaccagacctcgaaagaacatttcaatccgaacaatgcctttgacgccgaaggtttaaccaaactgactcaggaaacagagcgccgtcgccgcgaacgtaacgaagttgaacaggatgtagaagttgcggtgcgtgaaaaaaatcgcgatgcgctatcgcgcaagctggagattgaacagcaagaagcgtttatgacgcttgagcaggagcagcaggttaaaacccgtactgccgaacagaatgcacgtattgcggcttttgaagctgaacgtcgtcgtgaagcagagcagacacgaattctggctgaacgacagattcaggaaacagaaatcgaccgcgaacaggccgtccgctcaagaaaggttgaagctgaacgtgaagttcgcattaaagagatcgaacagcagcaggtcaccgaaatcgctaaccagacgaaatcgatcgctattgccgccaaatcggaacaacagtcccaggcagaagcgcgtgctaatctcgcacttgcagaagcggtaagcgcccaacaaaacgtagaaaccactcgccagactgccgaagccgatcgtgctaaacaagttgccctaatcgctgccgcgcaggatgcagaaaccaaagcggttgaactgaccgtgcgggcgaaagcagaaaaagaagccgcagagatgcaggcggcggctatcgttgagttagccgaagctacacgtaaaaagggtctggcggaagcagaagcacaacgtgcgctgaacgatgctatcaacgtactttctgatgaacaaaccagccttaaattcaaactggccttgttgcaggcgctgcctgcggtaatagagaaatccgttgagccgatgaagtcaatcgacggtatcaagattattcaggtcgatggtctgaatcgtggcggcgctgcgggtgatgcaaacacgggtaatgtggggggcggaaacctggcggaacaagcattatcagccgctctctcttaccgcacacaggcaccgctgattgactccttgctcaatgaaattggcgtttcaggcggctcactggcggcattgacttcacccttaacctcaacaactcccgtcgaagaaaaagcagagtaaaccctcttccaggaataatccctggcccaaaaagccggggattttttatatctgcgttccgctaaaaagtgcaaatgatcaggttgttgcagcattttgcgtgacggctcggggaaggcaaaactgcatcagagaaagcattgcgtggggtctggcgctcatcaacaatcggggagtcagcagggggctgaaacgggaaagcccctcccgaagaagggggccttacagaaggaaagggttatgatgaagctcgtcatcatactgattgtgttgttactcgtaagtttcgcagcttattaacagccaatcagaggggggagaaatcctccctcacccttgttcctttactttaggttgaaaaaaaatcagcgtcaagaaggtttcattaacacatatccctggcccaaaaagccggggattttttatatctgcgttccgctaaaaggtgcaaatgctcaggacgttgcagcgttttgcgtgaccgctcggggaaggcaaaattgcctctgggaaagcattgcgcggggtccggcgctcatcaacaatcggggggcagcaaggggctgaaacgggaaagcccctcccgaagaaggggccttgtataaggaaagggttatgatgaagctcgtcatcatactggttgtgttgttactgttaagtttcccgacttactaacaactcatcagaggggggagaaatcctcccttacccttgttcctttactctaggttgaaaaaacaacagcgtcaataggcctgccatgtacgaagcgagatctgtgaaccgctttccggttagccttttttatcctgttggatcttcttgatgatgttggtcgtcgagcaaccgtcttcaaagttgagcaccaacacttcgccaccgttggcccagacttctttactcccggcaatctcttctggtttatagtcgccgcctttcaccagcagatctggcaagatcccggcgatcaagcgctgcggcgtgtcctcttcaaacgacactacccagtcgaccgcttccagtgcgcccagcacaatcatacgctgttcgagtgggtttaccgggcgggaatcccctttcagccgtttggtggaggcatcgctgttgacggcaacaatcaagcggtcacccagcttgcgggcatttgccagataagagacgtgcccggcgtgcaggatgtcaaagacaccgttggtcatcaccactttttcaccacgtttacgcgctgccgctacggccagcttcagttcctcttcggtcatcacgccaaagcctgtatctgcacgtccacgtacagcattttccagctcgatcggcgaaaccgtggaggttcccagtttgccgaccaccacgccagccgccgcattggcaaagaagcaggcttcttccagcgaattacccgctgccagcgttgccgccaggacgccaatcaccgtgtcgcccgcaccggtaacgtcatacacttcctgcgcttgggttggcatatgcagcggcgctttacccggttgcagcagcgacataccctgttcggaacgggtcactaacagagccgagagttcgtaatcggcaatcagtttcatgccgcgctcaacaatctcttcttcggtcttacatttaccgacaacagcttcaaattccgagagattcggcgttaacagcgtagcgccgcggtagcgctcaaaatcggtaccttttggatcaatcagcaccggaacacccgctttacgcgccagttggatcatctgctgtacgcttgccagcgcacctttggcgtagtcagaaagcaccagcgcgccaatcgaactcagcgcctgattaatccgctcgtgcagcggctgcggatcaacaccttcgaaaccttcttcaaaatccagacggatcagctgttggttgcgggaaagtacccgtaatttggtaatggtcggatgcgtcggtacagaaacgaagtcgcatttgacgttgacgtcggccagagatttactcagcgcgcgcgctgcatcgtcaatgcccgtcaacccgaccaggcgtgcattagcaccgagagaagcgatattcatcgccacgttagccgcgccgcccggacgttcttcgatggtattcactttaaccacgggcaccggcgcttccggcgagatacgactggtggggccgtaccagtaacgatccagcatcacatcaccaaccaccatcactcctgcacgttcaaactctggcagcgttactttcattcctgtctcctgagagattcaaaatttgcgcgcgataataccatacttcattcttccaccagccacttctgccagcttgcccgcaccagttcacgctctgcggtgaagcaatcctccgacacatggcccggcaattcctgtaatgccagatgatgaagttcatcgcgaagcgtagtgtaagcacgggtcagcgccatcgcttcctgctcttccataatgtcgttttgcgccagtagttccagaatacgcacgttgtctgaccagcgcgttaacttcggtttttcatgagcgtagcgcaacaccagatattgggtaataaattcgatatcggtaattcccccttcatcagctttgatatcaaagcgatcgcgatgtttattgccgagatgagcgcgcattttctcgcgcatttcccgcacttccgtttgcagagttttaccttcacgcggcagcgtcataatctcgcgacgcactgcgtcaaagtgcgcggtgagctgcggatcgccgtacactacacgcgcacgcaccagcgcctgatgttcccacgtccaggcctcgtttttctgataatcggcaaatgcttctgcggatgtcaccagcattcccgccgccccggacggacgcagtcgagcatccacttcatacaaaatgccggaagaggtacgcgtactgaacagatgcataatgcgttgcgccagacgcagataaaactgccgcccgtcgatttcccgctcaccgtcagtcatcgcatccattgggcaatcatggaggaagataaggtcaagatcggaactgtagcctaactcccagccgcccagcttgccgtagccgaccaccgcaaaaccacgcccttcgcgttcgttcaggtgattcggcttaccgtagcgggcaaccatttgaacccacgcctgctgaacgacggcatctatcatggcttccgccagccaggttaagtgatcgctcactttcatcaccggtagcgtaccggcgatatccgctgcggcgatgcgtaacagctgcgcctgtttgaactgacgcagcgcctcaagctgttgctcttcgtcatcttccggcacgcgcagcaaatactggcgcaactcatcgcggtaggcatcggtcgccgtcggctggtaaagggtgtttggatcgagcaattcatccagcaataatggataacgcgccagctggctggcaatcatcggcgacgcggcacacagagaaatcaaatgtttaagcgccgcggggaattcactgagcaattctaaataggtggtgcgggtaacaatccccaccagcaaggcggtaatgcgcgacagcgtaacggcagcgtcttcacgcgcacagacatcacttagcagatgcggcatcagatggtcgagcacctgacgtcctcgcggcccgatggtgcgcttatccagctctttgcggaaatcggcaatcagcgttagcacctgtttgcgatcatcctcgctaagatgcgccagcactggcgtagtgtcatcttcctgcaacgcatcctgccacagctcacgccactgttccgacagcgactcttcctgagtttcactttcatcgtcgccaatcaattcattaaacacccggcgcacattggtcatatgtgcggtcagcgccccggtcagttgcggccagtcagcaaagtccatcgcccacgccagccgcgcacgattaagctcatcagaaggaagcgtctgggtttgttcgtcgttaatgctttgcagcaggttttccagacgccgcaggaacagatacgccactcgcaattgttcagcatcgttttcagaaagcagatgcagctcggcaatggcgctgagcgttggcagtaaagagcgcgattgcagcgacggttcgcgtccgccgcgaatgagctggaacacctgaacgataaattcaatttcgcgaatgccgcctgcgccgagtttgatattgtcggtcaaaccacgtcgacgcacttcacgggcaatcatccctttcatgttgcgcagcgactgaatcacgctgaaatcgatgtaacgacggaaaacaaacgggcgcagcatcgcacgcaactcgttagcatagacgccttcgctatcgcccataatccgcgccttgaccatcgcgtaacgctcccagtcgcgcccctgctcctggtaataatcttccaacgcggcaaagctcagcaccagcgggccactttcgccaaacggacgcagccgcatatccacgcgatagacgaagccatcctgcgttggttgatccagcactttaatcagccgctgccccatgcgggtaaaaaactgcgcgttatccagttcccggcgtccaccctgcgtacaaccatgttccggccaggcaaaaatcagatcgatatcagaggagaaattcagctccccaccgcccagcttacccatgcctaaaatcagcagcggttgcgcttcgccctgcgcattgcacggcgttccccactcgcggcagcaggcgtcatacagccagtcacgcgccgcaacaatcagcgtctccgccagatagctgagctgctgcaatatgctctcttcagtaaccagtgccagcgtttgcgcccaggcgatgcgcaccataatgcgccgccggaatagccgcagctcgcgcattaacccggcttcgtcactcacattacagagcgcctcctgcaaccatgccgcgtaatgctgccattcgtcggcctgcggcggttggctttccagttccgtcagccactctggatgcgcaatcacgctgtcctgcacaaaatcactaaaagtaagtactgacttcgcctgtgcgctaagtgattcctcggctaaaggctctggcagccgctcaacaacggtctgccagtactgctgtaacggtgaagagagcggcttcataagcgattttatccttgcctgattaacgttttccgctgtgcaaccagaacggttcctgattgtttgcctcattacggaaatgttcaatttcgatgcgttgcccggtcgcaatagcgtgatgcagcccctgccagttctccagccaggcttgcgcgacgacaggatcatagtaacccgccagcaacagtattgagtcaatatcacgcgtcaggcgtggcaactggtcacggtagcgatcgcctaacggctggcagaaaacgcttttcagttcagcggcatggcgggaaagatggatatcggcaaagcgtttgaaggagtcgctgattttgccctgcgctttggcatctaaaaatggctgccatgctttgcttaccaaccattcggtcaacgccagcttcgccattgccgtttcggtagagtagaccgccgtcacggcagacaccgcagaagcaatggtcgcctcgcattgagtcagcagatcacgtaagtgagtgctcgctttacgcggcacaataccaccgaacagcatcagcgtatgacggaccaggctaatggctgccagcacctgttctttcgccgcatcgttgccgcgtacccacagttcttcatgatactgccattgcgctaacgccagctcgagcgccgcttccagcccctgttccacatcggcttttgccgcaacatgcaaaatggtggtcggtttgatttcacgcgccggattgccctgcgccagatgatagccacgcgccgctttgctcaggctgccctggcgtaatccggtttgcgataccagttggttcgccagtttcagcaccgcgcgcgtgtcgccgctaagcagttccagttccagctcacagataggttcagcaaattcacccgctttcacttccccctggtcgagggcgatttcaatttggctaccatcgaccgccaccagccatttttcgcgataaaaatcggtgctgaacagcggctgcacgcgggaggcgagatcggcgggcaattcgccgttcggccagacttccgtcggtaactgcgccaggtcgagcgtcggttcgctcaacgccacgttatattccgggcgctgatgtaagccgcctgtcactcttcctgcaactttcatggtcatctcatagcgaccgttttcgccacgaatacgtaagcccatatcgtgcccacgcagccagttatccggcgtttcgtagtaaatattcagcaactgcacggggtcatggtgctcgccgcccagcgtattgagatggtcacgcaacgcctcaacggcactgtgattaacaataaactttaattcgatttcctgagccatggcctttacttatcggttatgtcacataagtgacgatgaacggcgaacttaatgcgatcttttttgtcagtagatagtattttgcgccaaattgccatgcaacgggcaatttgacgggcgtaaaagtttgaagcagtggcaagacctgacacagaggattccgattgatgtcgaatgctttgcgtagcgacactgatgccactactatcgttccactttccatgacaataacgacagcctgatgccaaaattacgcctgatcggattaactttactcgcacttagcgcgactgccgtctcacacgctgaagaaacgcgctatgtttccgacgaactgaatacctgggtccgcagcggtccgggagatcattatcgcctcgtgggcacggttaacgccggcgaggaagtgaccttattacaaactgacgccaacaccaattatgcccaggtgaaagacagctctggccgtaccgcctggatcccgttgaaacaacttagcactgagccaagcctgcgctcccgtgtgccagatctggaaaatcaggtcaaaaccctgaccgataaactcaccaatatcgataacacctggaatcagcgcaccgcagaaatgcagcaaaaagtggcgcagagcgacagcgtgatcaacgggttaaaagaagaaaatcagaaactgaaaaacgagctgattgtcgcgcagaaaaaggtcgatgccgccagcgtacagctggatgacaaacagcgcaccatcatcatgcaatggtttatgtatggcggtggcgtgctggggcttggcttgctgctcggtctggtactgccgcacctgatcccaagccgcaaacgcaaagatcgctggatgaactaaatcgccttcttcgttgcactgtcttattattaggaattgtgtatttgacgaagggatgatggcgtgaagatttatctggtcggtggtgctgttcgggatgcattgttagggctaccggtcaaagacagagattgggtggtggtcggcagtacgccacaggagatgctcgacgcgggctaccagcaggtaggccgcgattttcctgtgtttctgcatccgcaaacgcatgaagagtatgcgctggcacgtaccgaacggaaatccggttccggttacaccggttttacttgctatgccgcaccggatgtcacgctggaagatgatcttaagcgtcgcgatctgaccattaatgcgctggcccaggacgataacggcgagattatcgacccgtacaacggtctgggcgatctgcaaaatcgtctgttgcgccatgtttcccccgcttttggcgaagatccgttacgcgtattgcgcgtggcgcgttttgctgcgcgttatgcccacctcggttttcgtattgccgatgaaactctggcgttgatgcgcgagatgacccatgcgggtgaactggaacacctgacgcctgaacgggtatggaaagagacggaaagcgccctcaccacccgcaatccacaggtgttcttccaggtactgcgcgattgcggcgcactgcgcgttttattcccggaaattgacgcactgtttggcgttccggcccctgccaagtggcatccggaaatcgatacgggtattcataccttaatgacgctctcaatggcggcgatgctgagtccgcaggtcgatgtccgtttcgcaactttatgccacgatctcggtaaagggctgacgccgccagaactctggccgcgtcatcatggtcatggcccggcgggtgttaagttagtggaacaactatgccagcgtctgcgcgtgccaaatgaaattcgcgatttagccagactggtggctgagtttcacgatctcatccacaccttcccaatgctgaacccaaaaaccatcgtcaaattatttgattccatcgatgcctggcgtaaaccgcagcgtgtcgagcaactggcgctgaccagcgaggctgacgtgcgcggcagaaccggttttgaatcagcggactacccgcaaggccgctggttgcgcgaagcctgggaagtggcgcagtcagtgccgacaaaagccgtcgttgaagcgggatttaaaggtgtggagattcgcgaggagctgacccgacggcggattgcggcggtagccagctggaaggaacaacgttgcccaaagcctgaatgagtattgggcattttgccggatgcggcgtaaacgccttatccggctacatgtcaacgacagttgtaggcctgataagacgcgcaagcgtcgcatcaggcgttgattgccggatgcggcgtgaacgccttattcggcctacgcaatcgttgacaacgccaagcatccgacactattcctcaattaaaagaacacgacatacaccgcagccgccacaataaagcgataaatggcgaacgggataaacgaaatgcgcttaatcaattgcaggaaggttttaatcgctatcagcgccaccacaaaagcggtgataaacccaacggcaaacatcgggatatcgccgcttgtcaggaagccccagcttttgtagagatcgagcgccgttgcgcccatcatcatcggcaccgccagcaggaacgaaaactcggaagcagcgtaacggctcacccccatcagcatcccacctgaaatggtcgccccggaacgggagaaacccggccacagcgccagacactggaaacagccaatcataaatgcctgacgataggtcatatcatcaagacccggcgcacgcggctctttcggcttcaggcattcggcggcaatcagcaacaaaccgccaacgaccagcgcatacatcacatttatcgggttaaacaatgacttaatcgtgtcgtggaacaacagccccaataccaccgccggaatcatccccagcaaaatgtggatcagcgttaaacgacctttgctttcaccttcgtgctgcaacgggcggccaaagtggatgccaatcaggccaaacagacgccgccagaacatcactactaccgccagaattgatcctaactggatcacaacttcaaaggttttcgccgtgtcgccctcaaaccccaacaagtgaccgacaataatcatatggcccgtgctggataccggcagaaattctgtcaatccttcgaccacacccaatattgccgctatcagcagcgagtgcatatcgctcatcaataaacccctaaattattaaaatgtaccgcttgtccgaactactgcgtatgaccaggttataaccgtttggtttaacagctgtaaaattaattattttctttcagattattgccacgctcaatgattacgccaacattcgccgcccgcgccactgcgcctggcttgctgagtttgatacgcacccacggcgagttgaagcgtgctaacagcagctccgccacctcttcagccacgcgttccaccagcgcaaaacgcgccccctcgacgtggctgaccaccgtttctgcaatgtcagcgtaactgaggcaatccgccacatcatcacttttcgccgctttacggttatcccacgccatttcgatatcgaacactaacttctgttcgatggtctgttcccagtcgtaaacaccaatagtggtgattaccgaaagttgctctataaatacaatatccatcacgtcctgcctgctttttggctaaccggataccacttccggcgaaatgtgcgtattatccacagattcatcgttgaacacgaattttcaaaacggaacagcttatgagtgcaatcgcgcctggaatgatcctcatcgcgtacctctgcggctccatttccagtgccattctggtttgccgcttgtgtgggctgcccgatccgcgaaccagcggctccggcaatccaggcgcaaccaatgtgttacgtatcggtggcaagggagcagccgtagcagtactgattttcgacgttctgaaaggaatgttgcccgtctggggcgcgtatgaattaggtgtcagccccttctggctaggcttaattgccatcgccgcctgtcttggacacatctggcccgttttcttcggatttaaaggaggaaaaggcgttgctaccgcttttggtgccatcgcacccattggctgggatctcaccggagtaatggcgggaacctggttactgaccgtgctattgagcggatactcgtcgctgggagcgattgtcagtgcactgattgctccgttttatgtctggtggtttaagccacaattcaccttcccggtttcgatgctctcttgcctgatcctgctgcgtcatcatgacaacatccaacgtctgtggcgtcgtcaggagacaaaaatctggacgaaattcaaaagaaagcgcgaaaaggatcccgagtgatttctggtggatctacatgacctgatagccttcatcgggcttgcccagccgttgctggcaccatgccgccagaaattccacgcagacacgtaatttcatgctgcgatagagcggctcccggtaaacagcccagatattggcgctttgtgcatactctggcaatacttgcaccagtttgccactctccagaaacggcaacacatcccactcggaacgcagcataatccctttgccctccagcgcccattgcagcacaatctcgccgctattggaggaaagatgcccgcttaccttcaccgattttttctcctgaccgttccccaactcccatattccatgggtcatatcgcgctctttggtcaccagacagtcatgacgacttaattcctgtagggattgtggctgcggatatttttgcagatactcaggtgctgcgcataatattcttttattttttgtcaaaagatgcgcaatataataatcaggaatttcgtcattaatacgaatatccagatcaatattatcctgcactaaatcaatttgccgatcgaacaattcaaaatgcacctgtaactcaggataattgcgcatcagttcggtaatagctggcgcaatatggctgcgcccaaaaccaaaactgcaaccaatacgaatcatcccctccgggcgcgttttgatttgcgtgacgtcatcgaccagtcgctgatattgggtgaggatttccaacgcatgttcgtaacaacgttggccactttcagtcagcgccacgccgcgagcggagcggttcagcagcgttgttgccagcgtattttcaaggatttggatccgcttggtgacaaatgcaggcgtctgcccaagcgtcgccgctgcggcgctaaaactcccgctgtgaacgatttctaccagtacctgcaagtctttggctaaaggccagctattcagcatcgttaattatccgcagttgtgataagcgcagtgtatttcgcaaaacattgccattccctgctctggcgcaatattcattcttattttcgcgttgattcacgaactgttaattacatattcacggtggcaaaaaatataaaaccacatttttagtggtagtttgtggcggtgaatttttccagacaaatacaaaaactggagttgccatgatgagcgaaagtaataagcaacaggcagtgaataagttgacagagattgtcgctaactttaccgccatgatttctacccgaatgcctgatgacgtggtggataaactaaaacagctaaaggatgccgaaacgtcgtcgatggggaaaattatctaccatacgatgttcgacaacatgcaaaaagcgattgacctgaatcgtcctgcctgtcaggacaccggggagattatgttcttcgttaaagtcggttcccgcttcccactgcttggcgagctgcaaagcatactcaaacaagccgtggaagaggcaaccgtcaaagcgccactacgtcacaatgcggtagaaatttttgacgaagtaaacaccggcaaaaataccggtagcggcgtaccgtgggtcacctgggacatcatccccgacaatgacgatgcggaaatcgaagtttacatggcaggcggcggctgcacgctacctggccgctcgaaagtgttaatgccgtcagaaggctacgaaggcgtggtgaaattcgtcttcgaaaatatctccaccctcgccgtaaacgcctgtccaccggtactggtgggcgtgggcatcgccacctcggtggaaaccgccgccgtactctcgcgtaaagccattttgcgcccgattggcagccgccatcccaatccaaaagcggcagaactggagctacgcctggaagaaggactcaaccgtctggggattggtccacaagggctgaccggcaacagttcagtgatgggcgtacatatcgaatctgccgcccgccatccgtcaaccatcggcgttgctgtctctaccggctgctgggcgcatcgtcgcggcacgctgctggttcatgccgatctcacctttgaaaatctgtctcacacccggagcgcgttatgaaaaagatcctgacaaccccgatcaaagctgaagatctgcaagatattcgcgtcggcgatgtgatctacctgaccggtacgctggtgacctgccgcgacgtttgtcaccgccgtttgatcgaactgaaacgtccgatcccttacgatctcaacggcaaagcgattttccacgctggccccatcgtgcgcaaaaacggcgacaaatgggagatggtctccgtcggcccgacaaccagtatgcgtatggaaagttttgaacgtgaatttattgagcagaccggcgtgaaactggtggttggcaaaggtggtatggggccgctgaccgaagaaggctgccagaaattcaaggcgctacatgtgattttcccggcaggctgcgcggtgctggcggcaacccaggtggaagagattgaagaagtgcactggacagagctcggaatgccggagtcactgtgggtctgccgggtcaaagagttcggcccgctgattgtctctattgatacccacggcaacaacctgatagccgaaaacaaaaagctgttcgccgaacgccgcgatcccatcgtggaagagatctgcgagcacgtccattacatcaaataaccctcccggagaggctcacccctctcctttttcgcaggcataacacgatgaaaccttccactgaatggtggcgatatcttgcgccgctggcggtcatcgccattattgctctacttccggttcccgcagggctggagaaccatacctggctctactttgccgtttttactggcgtgatcgttggactgatcctcgaacccgtgccgggtgccgtggtggcgatggtgggtatatccatcatcgccatactctctccctggctgctgttcagcccggagcagctcgctcagccaggctttaaattcactgcaaaatccctctcgtgggccgtttccggtttttctaattcggttatctggctgattttcgccgcctttatgtttggcacaggctatgaaaaaaccgggcttggacgccgcattgcgctgattctggtgaaaaagatgggacatcgcacgctgtttctcggctatgcggtgatgttctccgagctgatcctcgcacctgtaacaccgtccaactcggcgcgtggtgcggggattatctatcccatcatccgtaacctgccaccgctctatcaatcacaaccaaacgacagcagttcgcgcagcattggctcgtacatcatgtggatggggattgttgccgactgcgtgaccagcgccattttcttgacggcgatggcaccaaacttgctgttaattggactgatgaaaagcgcatctcacgccacgctgagttggggcgactggttcctcgggatgttgccgctcagcattttactggttctgctggttccctggctggcttacgtgctgtacccgccggtactgaagtctggcgatcaggtgccgcgctgggcagagacggaactgcaggcaatgggcccgctctgttcgcgtgaaaaacggatgctggggctgatggtaggcgcgctggtgctgtggattttcggcggtgattatatcgatgccgcgatggtcggttacagcgtggtggcactgatgctgcttctgcgcattatcagttgggacgacattgtcagtaataaagcggcgtggaacgttttcttctggctggcctcgcttatcaccctcgccaccggactcaacaacaccggttttattagctggtttggcaaactgttagcaggcagcttaagcggttattcgccaacgatggtgatggtggcgttgattgtggtgttttatctactgcgctactttttcgccagcgccacggcgtatacctccgctctcgcaccgatgatgattgctgctgcgctggcgatgccggaaatcccgctgccggtgttctgcctgatggttggtgcggcaattggtctggggagcattcttacaccatacgccaccggccccagtccgatttactacggcagtggttatctgccaacggcggattactggcgactgggggcgatttttgggctgatattcctcgtattgctggtgattaccggcttactgtggatgcccgtggtgttgctttaagtgaggacggtgccggaaattgctctccggcacccaatagttttacgcagccggtaactccgccagcggccagcgcggacgcacgctaacgccgagatccgccgtcgcgcctgctttaaaccgcaccattccggcataggcgatcatcgcgccgttatcagtacaaaattccggacgcgcgtagaacacttcgccgcggcgttttttcatcatttcagccagcttcgcccgtaacgtacggttagcactcacgccgcccgccatgaccagtcgcttaaagcccgtctgatccagcgcccgcttgcacttaatcatcagcgtatcgaccaccgcatcttcaaaggcgcgggcgatatcagcacgcgtctggtcgtcggtgccgttgtcacgaatggtatttgccgcgaaggttttcaggccggagaagctgaaatccagccccggacggtcggtcatcggacgcgggaagacaaagcgcccggcagtaccctgagccgccattttcgacagtaacggcccgccaggataatccagccccagcagcttcgcggttttatcaaacgcttccccggcggcatcatcgatagactcgccgagcagctcgtactgaccaatgccagtcacgctgattaactgcgtatgaccgccggaaacaagcagcgcaacaaacggaaattccggcgggttatcttccagcatcggcgctaacagatgcccttccatatggtgtacagggatcgccggaacgtcccaggcaaacgccagagaacgccccacggtcgcgccaaccagtagcgcgccgactaatccagggcctgcggtataggccacagcatcaatgtcttttgccgttaaaccagactcctttagcgccgcctggatcaacggtacggttttacgcacatgatcgcgggaggccagttcaggcacgacgccgccgtagtcagcgtgcaatttcacctgactatacaattggttggctaacaaacctttttcatcgtcgtaaatggcgatgccggtttcatcgcaggaagtttcaatacccagtacacgcatgacttgttttacctcgctttattaccgcgcagtgtaggaccaatgcgggttgatgtaaaactttgttcgcccctggagaaagcctcgtgtatactcctcacccttataaaagtccctttcaaaaaaggccgcggtgctttacaaagcagcagcaattgcagtaaaattccgcaccattttgaaataagctggcgttgatgccagcggcaaaccgaattaatcaaaggtgagaggcacatgccggtaattaaagtacgtgaaaacgagccgttcgacgtagctctgcgtcgcttcaagcgttcctgcgaaaaagcaggtgttctggcggaagttcgtcgtcgtgagttctatgaaaaaccgactaccgaacgtaagcgcgctaaagcttctgcagtgaaacgtcacgcgaagaaactggctcgcgaaaacgcacgccgcactcgtctgtactaattccccgagagcgttgctctccgatcagaccgagttgtagttgtaaggccgtgcttccgaaaggaatgcgcggcttattttcgtttatgaattgctaaaaatcggggcctatggctggacgaatcccacgcgtattcattaatgatctgctggcacgcactgacatcgtcgatctgatcgatgcccgtgtgaagctgaaaaagcagggcaagaatttccacgcgtgttgtccattccacaacgagaaaaccccgtccttcaccgttaacggtgagaaacagttttaccactgctttggatgtggcgcgcacggcaacgcgatcgacttcctgatgaactacgacaagctcgagttcgtcgaaacggtcgaagagctggcagcaatgcacaatcttgaagtgccatttgaagcaggcagcggccccagccagatcgagcgccatcagaggcaaacgctttatcagttgatggacggtctgaatacgttttaccaacaatctttacaacaacctgttgccacgtctgcgcgccagtatctggaaaaacgcggattaagccacgaggttatcgctcgctttgcgattggttttgcgccccccggctgggacaacgtcctgaagcggtttggcggcaatccagaaaatcgccagtcattgattgatgcggggatgttggtcactaacgatcagggacgcagttacgatcgtttccgcgagcgggtgatgttccccattcgcgataaacgcggtcgggtgattggttttggcgggcgcgtgctgggcaacgatacccccaaatacctgaactcgccggaaacagacattttccataaaggccgccagctttacggtctttatgaagcgcagcaggataacgctgaacccaatcgtctgcttgtggtcgaaggctatatggacgtggtggcgctggcgcaatacggcattaattacgccgttgcgtcgttaggtacgtcaaccaccgccgatcacatacaactgttgttccgcgcgaccaacaatgtcatttgctgttatgacggcgaccgtgcaggccgcgatgccgcctggcgagcgctggaaacggcgctgccttacatgacagacggccgtcagctacgctttatgtttttgcctgatggcgaagaccctgacacgctagtacgaaaagaaggtaaagaagcgtttgaagcgcggatggagcaggcgatgccactctccgcatttctgtttaacagtctgatgccgcaagttgatctgagtacccctgacgggcgcgcacgtttgagtacgctggcactaccattgatatcgcaagtgccgggcgaaacgctgcgaatatatcttcgtcaggaattaggcaacaaattaggcatacttgatgacagccagcttgaacgattaatgccaaaagcggcagagagcggcgtttctcgccctgttccgcagctaaaacgcacgaccatgcgtatacttatagggttgctggtgcaaaatccagaattagcgacgttggtcccgccgcttgagaatctggatgaaaataagctccctggacttggcttattcagagaactggtcaacacttgtctctcccagccaggtctgaccaccgggcaacttttagagcactatcgtggtacaaataatgctgccacccttgaaaaactgtcgatgtgggacgatatagcagataagaatattgctgagcaaaccttcaccgactcactcaaccatatgtttgattcgctgcttgaactgcgccaggaagagttaatcgctcgtgagcgcacgcatggtttaagcaacgaagaacgcctggagctctggacattaaaccaggagctggcgaaaaagtgatttaacggcttaagtgccgaagagcgatcgggaagcccccgacagccgcactgagaggcagcggcaaatatataagtacgccctcgtaattatcgttggcggtaaacaaccgttggatttcagcgttaacggctgaaggacatcgggtcaatcgcccaacaccaacctcatgaaataagtgtggataccgtcttatggagcaaaacccgcagtcacagctgaaacttcttgtcacccgtggtaaggagcaaggctatctgacctatgccgaggtcaatgaccatctgccggaagatatcgtcgattcagatcagatcgaagacatcatccaaatgatcaacgacatgggcattcaggtgatggaagaagcaccggatgccgatgatctgatgctggctgaaaacaccgcggacgaagatgctgccgaagccgccgcgcaggtgctttccagcgtggaatctgaaatcgggcgcacgactgacccggtacgcatgtacatgcgtgaaatgggcaccgttgaactgttgacccgcgaaggcgaaattgacatcgctaagcgtattgaagacgggatcaaccaggttcaatgctccgttgctgaatatccggaagcgatcacctatctgctggaacagtacgatcgtgttgaagcagaagaagcgcgtctgtccgatctgatcaccggctttgttgacccgaacgcagaagaagatctggcacctaccgccactcacgtcggttctgagctttcccaggaagatctggacgatgacgaagatgaagacgaagaagatggcgatgacgacagcgccgatgatgacaacagcatcgacccggaactggctcgcgaaaaatttgcggaactacgcgctcagtacgttgtaacgcgtgacaccatcaaagcgaaaggtcgcagtcacgctaccgctcaggaagagatcctgaaactgtctgaagtattcaaacagttccgcctggtgccgaagcagtttgactacctggtcaacagcatgcgcgtcatgatggaccgcgttcgtacgcaagaacgtctgatcatgaagctctgcgttgagcagtgcaaaatgccgaagaaaaacttcattaccctgtttaccggcaacgaaaccagcgatacctggttcaacgcggcaattgcgatgaacaagccgtggtcggaaaaactgcacgatgtctctgaagaagtgcatcgcgccctgcaaaaactgcagcagattgaagaagaaaccggcctgaccatcgagcaggttaaagatatcaaccgtcgtatgtccatcggtgaagcgaaagcccgccgtgcgaagaaagagatggttgaagcgaacttacgtctggttatttctatcgctaagaaatacaccaaccgtggcttgcagttccttgacctgattcaggaaggcaacatcggtctgatgaaagcggttgataaattcgaataccgccgtggttacaagttctccacctacgcaacctggtggatccgtcaggcgatcacccgctctatcgcggatcaggcgcgcaccatccgtattccggtgcatatgattgagaccatcaacaagctcaaccgtatttctcgccagatgctgcaagagatgggccgtgaaccgacgccggaagaactggctgaacgtatgctgatgccggaagacaagatccgcaaagtgctgaagatcgccaaagagccaatctccatggaaacgccgatcggtgatgatgaagattcgcatctgggggatttcatcgaggataccaccctcgagctgccgctggattctgcgaccaccgaaagcctgcgtgcggcaacgcacgacgtgctggctggcctgaccgcgcgtgaagcaaaagttctgcgtatgcgtttcggtatcgatatgaacaccgactacacgctggaagaagtgggtaaacagttcgacgttacccgcgaacgtatccgtcagatcgaagcgaaggcgctgcgcaaactgcgtcacccgagccgttctgaagtgctgcgtagcttcctggacgattaatcggtaggccggatcaggcgttacgccgcacccggcactaggccctctgcacaaacgccaccttttcggtggcgttttttatcgcccacgcactaccagcgcctggtccagctcgcgatacgcttcaaccagtttctccagtgaaacgcgacttaaaccgctgggatttggcagcacccaaatctgcgtcgaaccaatggtgagcgtttgtttcccccactgtgcaccgcgctggctgaatccctgttcatatgcttgtttgcccagaatcgccaacgcctgcggctgataatcttcaattttttcaatcagcttacgcccgcctgcgtgtagctcctgctttgaaacttcattggcttgcaccgttggacggtctaccagtttggtgacgccacaacgataatccagcagatgctgtgcctcctgcggcttcaactgacggtcggtaaacccggcctgatatatcaccttccagaagcgatttgccggatgagcaaagggaaaaccagtcccggcggatgaaagcccagggttgataccgcaaaacacgacccgtaaccctggagccaaaatatcctcaaccatatttactcctttctaacatcaccaggaaaagtataacggattgaaaatacattgtttataaaaacagcaggcgcgcggtaatggctggattgcgacacggagttactttataatccgctaccatggccccttagctcagtggttagagcaggcgactcataatcgcttggtcgctggttcaagtccagcaggggccaccagatatagcaaaggctgacgagaaatcgtcagcctttttctttttatatatcagttactttgcgtgccagtaagccgctgcacgtacccgctgtgggtcatactgttccgcttcaaagcggcggcttaaattcttaacgactttaccttcgccggttatccagatgaagtaatcatcggcagggatttgcatctgcgccagacgcgcatctaccgcctgctcatcatgtgccagccattcgatattaaaaccatcaaggtgcgcgagataatcctgacaggcgttatcccgcacgctaaccagcgcactaacttgcggtttaacggcaagtttgctcaacgtttccaggcggcggcgcaatgcaggcattccggattcatcgcagacatacagctgatacgcgtaatcttccggcaccaccagcgaaccgcgcggacctgccaccgtaagtttatcgcccggttgcgcctgcatcgcccagccgctggcgaccccaccgtcgtgaataaagaaatcaatcgccagttcatggcgtagttcgtcatacagcggcgtatagtcacgcgacggtgggcgtggtccttccggccagacgatgccctcttccgttaccgttggcggcacaaagtgagcgtcaggttgaggaaagaagagtttgctgtgatcgtcaaagccacgcgatgtaaaaccgtccagcgcctcgccgccgaggacaatgcgctgaaaaccggcgctgatgcgctcaacgcgtaacacagtcagttcacggaagcgcagatcattgcgaacgcgctgcgggtagcggggggtgttattcattgttatcgccttcgtgatggtaatcagatatatctaaataaaactcgcaaatgataatgattgttaatcatgataaatgcaagcgatttgtagaactgatatgtctatagtctgataagacgaaccgcctcttctcaggcatcattactcaacgccggatgcggcgtgaacgccttatccggcctacgtgtgagatgagtccacgtttaaaaatcatttttacacttgcaagaacgctcatatcagatataaattagatatatctaattaagcaaaaggaggctgatatgagccatcatcacgaagggtgttgtaaacatgaaggccagccacgccatgagggctgctgcaaaggtgagaagtcagaacacgagcactgcggacacggtcaccagcatgaacacggtcaatgctgcggtggtcgccacggtcgcggcggcggtcgtcggcaacgtttctttggtcacggtgaattacgtctggtgattctggatattctctcgcgcgatgacagccacggttacgaattgattaaagcgattgagaatctaacccaggggaattacaccccaagcccgggcgtcatctacccaacgctggattttctgcaggagcagtcgctgattaccatccgcgaagaggaaggaggtaagaagcagattgcgctgaccgaacaaggcgcgcagtggctggaagaaaaccgcgaacaggtggagatgattgaagaacgcatcaaagcgcgttgcgttggcgcggcgctgcgccagaacccgcaaatgaagcgggcgctggataattttaaagcggtgctggatttacgcgtcaaccagagcgatatcagtgatgcacaaataaaaaagatcattgcggtgatcgaccgcgccgcttttgatattacgcaactggattaatcgccgcatccgccagtggcgcggtgcaattgccggatgcgacgcttgacgcgccttatccggcctacacccgctacacaccccgcaggcctgataagatgcgccagcatcgcatcaggcattgtgctccaaccgccggatccggcataccgattaatgcagtaccgtcaccgcgtcttccagtcggctggcgcggtgtttcaccatcgccgacacctgcgcactctcttccaccagctcggcatttttctgggtgatcaggttaagctcatccactgcacgggtcaggctggaaagcccatcggcctgttccagcgttgaatggctaatctgggcgatcaactgggtgacgtttttcacctgtgccacaatatcttccatcgtccgtccggcggcgtgtacctgctgcgaaccggattgcaccttatcagcactggcatcaatcagcttgcgaatatcgttggcagcattagcgctgcggctggctaaatgacgcacttcccctgccaccactgcaaaacctttgccctgttcgccggcacgcgccgcttccaccgccgcattcagggccagaatattggtctgaaacgcaatatcgttaatcagcgaagtaatggtgccaatgcgctgggtactgtcggcgatatcgtccattgtcttgatcaccgtggtcatcgcctccccaccctgcactgccgcattactggcagtgattgacagtttatcggcagccgacgccgtggcagagttctgtttcaccgacgccgccatttggttcatggtcgccaccgtttgctgaacgttatcaactgtctgctgggtatgttcgttcagttcatcggtgcctttcgccagcgtctcactgccatttctgacactggacacctggcttgagacatcgttaattagccaacggcacatcaggccaagttgccctaccgcacgtaatgtcagccccagctcatcgctgcgattcagatgctcaacactattacgttctccggtcgccaccttcagtgcctgatgggcaacattttctatcgggcgcacaatctgccattcaaaacaggcgcttgccaacaataccactaacgcacagaggatatacgtcaccaccggggcagcaacaaaccaaagcatggccgccagcaagataaacatcagggtcatcactccacgcgcccgccagcgaagcggtaatgaaggcagtttacccagccagcctttacgcaccaccaggcctttatgaatacgcttactggtacgtccggcgttcaacgctttgtacagcggctccaccgccgcgatctcttcatccgtcgcccgggtacgaatcgacatatagccactgatttttccctcgcgcaccatcggtaccgcattggcccgcacccaataatggtcaccatttttgcggcgatttttcacgatgccgctccagggctccccttttttcagggtgaaccacatatccgcaaacgccgcttttggcatatccgggtgacgcaccatgttgtgcggctgcccttgtaactcttgcaaggtatagccgctcacctgcacaaaagtgtcattagcatgagtgatatagctttgcagatcggtagtggacatcagagtggtatcgtccgccagcggggtattttgctgggtgacatacggatgagaagacatgttcgcgtcctgtgcaggttatatggttgttaacttcttgtcagagtttatgtcggccccgctgcggttatctttaaccgattaatttgatttagatcgcaatttgcgatttaaacacaaatctaattccttgatttaaaatactttcactctgttactatacgaaaacgttaattatcttgcccaaaaatcaggcaattattgccctgaaaacgtgcatttgcgcagcaatcatcaaatccatacccgacaaaaaccgtgcaaaataacaacaaatgttaacagatagcattaaatattgcacaaatgataaccgaatttgtgtttatcccgattttcgcgatcgcagccggagtggcgcaatccctgcaatacttaaatcggtatcatgtgatacgcgagcctccggagcatattttgaacaggttaccttcgagcgcatcggctttagcgtgcagcgcccacgccctgaatctcattgagaagcgaacgctggatcatgaggagatgaaagcacttaaccgagaggtgattgaatacttcaaagagcatgtcaatccggggtttttagagtatcgcaaatctgttaccgccggcggggattacggagccgtagagtggcaagcgggaagtttaaatacgcttgtcgacacccagggccaggagtttatcgactgcctgggaggttttggaattttcaacgtggggcaccgtaatccagttgtggtttccgccgtacagaatcaacttgcgaaacaaccgctgcacagccaggagctgctcgatccgttacgggcgatgttggcgaaaacccttgctgcgctaacgcccggtaaactgaaatacagcttcttctgtaatagcggcaccgagtccgttgaagcagcgctgaagctggcgaaagcttaccagtcaccgcgcggcaagtttacttttattgccaccagcggcgcgttccacggtaaatcacttggcgcgctgtcggccacggcgaaatcgaccttccgcaaaccgtttatgccgttactgccgggcttccgtcatgtgccgtttggcaatatcgaagccatgcgcacggctcttaacgagtgcaaaaaaaccggtgatgatgtggctgcggtgatcctcgaaccgattcagggtgaaggtggcgtaattctgccgccgccgggctatctcaccgccgtacgtaagctatgcgatgagttcggcgcactgatgatcctcgatgaagtacaaacgggcatggggcgcacgggcaagatgttcgcctgcgagcatgagaacgtacagccggatatcctctgccttgccaaagcgctcggcggcggcgtgatgccgattggcgcgaccatcgccactgaagaggtgttttcagttctgttcgacaacccattcctgcataccaccacctttggcggcaacccgctggcctgtgcggcggcgctggcgaccatcaatgtgttgctggagcagaacttaccggctcaggctgagcaaaaaggcgatatgttgctggacggtttccgtcaactggcgcgggaatatcccgatctggtacaggaagcgcgtggtaaagggatgttgatggcgattgagtttgttgataacgaaatcggctataactttgccagcgagatgttccgccagcgcgtactggtggccggaacgctcaataacgccaaaacgatccgcattgaaccgccactgacactgaccattgaacagtgtgaactggtgatcaaagcggcgcgtaaggcgctggcggccatgcgagtaagtgtcgaagaagcgtaatatcaaatcggatggcgatacgacgtcgccatccgatctttttatacgacgcgtacgcccgcaggcatcatccgctccggcgttaacagcacgctttcactgccgtcatcggtttccgcacacaacagcatgcattccgacgtttcaccacgcattttcgctttttgcagattgcataagaccaccaccgttttccccatcagctcttcttcgctgtagtacggcaccaggctggtcacggtttgcagcgttttttgccccacatcaacctgtacgatgtacagcttgtcggcgttttcatggcgtttcacttccacaatctttccgacgcgcatttccagacgtgcaaaatcagcgtaagccacggtttccattgcttcctcccttagggtaaaattttactaaactatagcaaaagtttttctcaatcctgtaggctaaaaatggagaatgcaggcgtgatcacattcgtgagccgctgtgttaccgttacagcgtcaaagaaacgcgctttatttactgaaaacaggtgacccgataagcacttcctctacaatgggggcgcacatcagggaaagtaaaaaaggtaaacatggcaacactaaaagacatcgcaatcgaagctggcgtatccctggcgacagtatccagggtcttaaatgacgatccgacattgaatgtgaaagaagagacgaaacatcgcattctcgagatcgccgaaaagctggagtacaagaccagtagtgcccgtaaactccagacaggtgcagtcaaccaacaccatattctggctatctacagctaccagcaggagctggagatcaacgatccttactatctggcgatccgccacggcattgaaacccagtgcgaaaagctgggcatcgagctcaccaactgttatgaacacagcggcttaccagacattaaaaacgtcaccggtattttaattgtcggcaaacccacgcccgccctgcgcgccgctgccagcgcgttgaccgacaatatctgttttatcgactttcacgaacccggcagcggttacgatgcggtggatatcgatctggcacgcatcagtaaagaaatcatcgacttctatatcaaccagggcgttaatcgtattggttttattggcggtgaagatgagcctggcaaggcggatattcgtgaggtcgcctttgcggaatatggccgactgaaacaagtggtacgcgaagaggatatctggcgcggcggtttttccagttcgtcgggttatgaactggcaaaacaaatgctggcgcgggaagactatccgaaggcactgtttgttgcttccgattccattgctatcggcgtactgcgggcaattcatgaacgaggcctgaacatcccacaggatatttcgcttatcagcgttaacgatatccccaccgcgcgatttacctttccgccgctctccaccgtgcgcatccattccgagatgatgggaagtcagggcgttaacctggtgtatgaaaaagcccgcgatggtcgcgcgctgccgctgttagtcttcgttcccagcaaattaaaactgcgcggcacgacccgttaaatccccttacacactgtccggcaatcgtttttgccggacagtgctgccgtttattttcgtgatccagttaaagtaaatgcatttacctgctactttttagtaaaaattttactaaactccccagcaattacacaaactaccatcaccatgaatggttccgatttctctctaccgggaggccctatgaatcgctgggaaaacattcagctcacccacgaaaaccgacttgcgccgcgtgcgtactttttttcatatgattctgttgcgcaagcgcgtacctttgcccgcgaaaccagcagcctgtttctgcccttaagcggtcagtggaatttccacttttttgaccatccgctgcaagtaccagaagccttcacctctgagttaatggctgactgggggcatattaccgtccccgccatgtggcaaatggaaggtcacggcaaactgcaatataccgacgaaggttttccgttccccatcgatgtgccgtttgtccccagcgataacccaaccggtgcctatcaacgtattttcaccctcagcgacggctggcagggtaaacagacgctgattaaatttgacggcgtcgaaacctattttgaagtctatgttaacggtcagtatgtgggtttcagcaagggcagtcgcctgaccgcagagtttgacatcagcgcgatggttaaaaccggcgacaacctgttgtgtgtgcgcgtgatgcagtgggcggactctacctacgtggaagaccaggatatgtggtggtcagcggggatcttccgcgatgtttatctggtcggaaaacacctaacgcatattaacgatttcactgtgcgtaccgactttgacgaagcctattgcgatgccacgctttcctgcgaagtggtgctggaaaatctcgccgcctcccctgtcgtcacgacgctggaatataccctgtttgatggcgaacgcgtggtgcacagcagcgccattgatcatttggcaattgaaaaactgaccagcgccagctttgcttttactgtcgaacagccgcagcaatggtcagcagaatccccttatctttaccatctggtcatgacgctgaaagacgccaacggcaacgttctggaagtggtgccacaacgcgttggcttccgtgatatcaaagtgcgcgacggtctgttctggatcaataaccgttatgtgatgctgcacggcgtcaaccgtcacgacaacgatcatcgcaaaggccgcgccgttggaatggatcgcgtcgagaaagatctccagttgatgaagcagcacaatatcaactccgtgcgtaccgctcactacccgaacgatccgcgtttttacgaactgtgtgatatctacggcctgtttgtgatggcggaaaccgacgtcgaatcgcacggctttgctaatgtcggcgatattagccgtattaccgacgatccgcagtgggaaaaagtctacgtcgagcgcattgttcgccatatccacgcgcagaaaaaccatccgtcgatcatcatctggtcgctgggcaatgaatccggctatggctgtaacatccgcgcgatgtaccatgcggcgaaagcgctggatgacacgcgactggtgcattacgaagaagatcgcgatgctgaagtggtcgatattatttccaccatgtacacccgcgtgccgctgatgaatgagtttggtgaatacccgcatccgaagccgcgcatcatctgtgaatatgctcatgcgatggggaacggaccgggcgggctgacggagtaccagaacgtcttctataagcacgattgcattcagggtcattatgtctgggagtggtgcgaccacgggatccaggcacaggacgaccacggcaatgtctggtataaattcggcggcgactacggcgactatcccaacaactataacttctgtcttgatggtttgatctattccgatcagacgccgggaccgggcctgaaagagtacaaacaggttatcgcgccggtaaaaatccacgcgcgggatctgactcgcggcgagttgaaagtcgaaaataaactgtggtttaccacgcttgatgactacaccctgcacgcagaggtgcgcgccgaaggtgaaacgctcgcgacgcagcagattaaactgcgcgacgttgcgccgaacagcgaagcccccttgcagatcacgctgccgcagctggacgcccgcgaagcgttcctcaacattacggtgaccaaagattcccgcacccgctacagcgaagccggacaccctatcgccacttatcagttcccgctgaaggaaaacaccgcgcagccagtgcctttcgcaccaaataatgcgcgtccgctgacgctggaagacgatcgtttgagctgcaccgttcgcggctacaacttcgcgatcaccttctcaaaaatgagtggcaaaccgacatcctggcaggtgaatggcgaatcgctgctgactcgcgagccaaagatcaacttcttcaagccgatgatcgacaaccacaagcaggagtacgaagggctgtggcaaccgaatcatttgcagatcatgcaggaacatctgcgcgactttgccgtagaacagagcgatggtgaagtgctgatcatcagccgcacagttattgccccgccggtgtttgacttcgggatgcgctgcacctacatctggcgcatcgctgccgatggccaggttaacgtggcgctttccggcgagcgttacggcgactatccgcacatcattccgtgcatcggtttcaccatgggaattaacggcgaatacgatcaggtggcgtattacggtcgtggaccgggcgaaaactacgccgacagccagcaggctaacatcatcgatatctggcgcagcaccgtcgatgccatgttcgagaactatcccttcccgcagaacaacggtaaccgtcagcatgtccgctggacggcactgactaaccgccacggtaacggtctgctggtggttccgcagcgcccaattaacttcagcgcctggcactatacccaggaaaacatccacgctgcccagcactgtaacgagctgcagcgcagtgatgacatcaccctgaacctcgatcaccagctgcttggcctcggctccaactcctggggcagcgaggtgctggactcctggcgcgtctggttccgtgacttcagctacggctttacgttgctgccggtttctggcggagaagctaccgcgcaaagcctggcgtcgtatgagttcggcgcagggttcttttccacgaatttgcacagcgagaataagcaatgaggatcatcgataacttagaacagttccgccagatttacgcctctggcaagaagtggcaacgctgcgttgaagcgattgaaaatatcgacaacattcagcctggcgtcgcccactccatcggtgactcattgacttaccgcgtggagacagactccgcgaccgatgcgctatttaccgggcatcgacgctattttgaagtgcattactacctgcaagggcagcaaaaaattgaatatgcgccgaaagagacattacaggtagtggaatattatcgtgatgaaactgaccgtgaatatttaaaaggctgcggagaaaccgttgaggtccacgaagggcaaatcgttatttgcgatatccatgaagcgtatcggtttatctgcaataacgcggtcaaaaaagtggttctcaaagtcaccatcgaagatggttatttccataacaaataacaactacggcggcaaaaggagtttgccgccaccgctaccctactcattttcggagatgtgttatgtctgataccaaacgtaatacaatcggcaaattcggcttgctctcgctgacttttgccgccgtttacagctttaacaacgttatcaataataatattgagcttggactggcctcggcaccgatgtttttcctcgcgacgattttttattttattcccttctgtctgatcatcgcagaatttgtttcgttaaataaaaactcagaagccggtgtctacgcgtgggtaaaaagttcgctgggcggacgttgggcatttattactgcctatacctactggttcgtaaacctgttctttttcacctcactgttgccgcgcgttattgcttatgcttcgtatgccttcctcggatacgaatatattatgacgccggttgccaccaccattatcagtatggtgctgttcgccttctccacctgggtttccaccaacggggcgaaaatgttggggccaattacctccgtcacttcaacgctgatgctgctgttaacgctctcctacattttactggcaggtacggcgctggttggcggcgtacagcctgctgacgccatcaccgttgacgcgatgatcccgaacttcaactgggcgttcctcggcgttaccacctggatctttatggccgcaggtggcgcggagtccgtcgctgtgtacgttaacgacgtcaaaggcggttcgaaatcgttcgttaaagtgatcatcctcgccgggatttttatcggcgtactgtattccgtctcctcggtgctgattaacgtcttcgtcagcagcaaagagttgaaatttaccggcggatcggtgcaggtattccacggcatggcggcgtattttggtctaccggaagcgttgatgaatcgctttgtcggtctggtgtcctttaccgcgatgttcggttccctgctgatgtggaccgcaacgccggtgaaaattttcttctccgaaatcccggaaggcatctttggtaagaaaaccgtcgaactgaacgaaaacggcgttccggcgcgcgcagcgtggatccagttcctgatcgtcatcccgctgatgattatcccgatgctcggttccaataccgtgcaggatctgatgaatactattattaatatgaccgccgcagcgtccatgcttccgccgttattcatcatgctggcttacctgaatttacgcgccaaattagatcacctgccacgcgatttccgtatgggctcccgccgcaccggtattatcgttgtttcaatgctgattgcgatatttgccgtagggtttgtcgcttcgacattcccgactggcgcgaatattctgaccatcattttttataacgtcggcggtattgttatcttccttggctttgcgtggtggaaatacagtaaatatataaagggattaacggctgaagagcgccatattgaagcgacgccagccagcaatgttgattaagcagaataataaaaaatgagcaggcattttccctcttcctggatgaggagagggaaaatagtttctgcctttatatttttataattacaacgataaaaggctgtactttttctttagctcatggattaacacaatgaaattaatcactgcaccatgcagagcattacttgctctgccgttttgctacgccttttctgcggcaggagaagaagcacgtccggcagaacatgacgacacaaaaacacccgcaattacctcgacatcttctccttcatttcgtttttacggcgaattaggggttggtggatatatggatttagagggtgagaataaacataaatacagcgacggtacctatattgaaggtggcctggagatgaagtacggctcctggttcggcctgatttacggcgaaggctggaccgtgcaggccgaccacgacggcaatgcctgggtgccagaccatagctggggtggtttcgagggcggaattaaccgtttctatggcggttatcgtaccaatgatggcaccgaaatcatgctcagtctgcgtcaggattcctcgctggatgacctgcaatggtggggcgatttcacccccgatctgggctacgtcattcccaatacccgcgacattatgactgcgctgaaggtacagaacttaagcggcaactttcgttatagcgtcaccgcgactcctgccggacatcatgatgaaagcaaagcctggctacattttggcaaatacgatcgctatgacgacaaatacacctatccggcaatgatgaacggttacatccagtatgaccttgccgaaggcatcacctggatgaacggtctggaaatcaccgacggcacaggacagctctatctcacgggcctgctaactcctaactttgccgctcgcgcctggcaccataccggacgcgccgacgggctggacgtaccgggaagtgaaagtgggatgatggtgagcgccatgtatgaagcgttaaagggcgtttatctctccaccgcttacacctacgccaaacatcgccctgaccacgctgacgatgaaaccacctctttcatgcagtttggtatctggtacgaatacggcggcggacgtttcgccacggcttttgatagccgcttctacatgaaaaatgcctctcacgatcccagcgaccaaatcttcctgatgcaatatttctactggtaataaggactgtaatttcatgaaaataaaaactattttaacgccagtaacctgcgctctgctgataagtttttccgcccatgccgctaacgccgacaattataaaaacgtgattaaccgtactggcgcgccgcagtacatgaaggattacgattacgacgatcaccagcgttttaatccgtttttcgatctcggagcctggcatggtcatctgttgccagacggccctaacaccatgggcggctttccgggcgttgcgctgctgacggaagagtacatcaactttatggccagcaatttcgaccgcctgaccgtctggcaggacggcaagaaagtcgactttacgctggaggcatacagtattcccggtgcgctggtgcaaaaactgacagcaaaagatgtgcaagtcgaaatgactctgcgcttcgccacgccgcgcacgtcactactggaaaccaaaatcaccagcaataaaccgctggatctggtgtgggacggcgaactgctggaaaaactggaagcgaaagaagggaaaccgctttccgataaaaccattgctggcgaataccctgactatcagcgcaaaatcagcgccacccgtgatggcctgaaagtcacctttggcaaagtgcgcgccacctgggatctgctgacctccggcgaatcggaatatcaggtgcataaatccctgccggtgcagactgaaatcaacggtaatcgctttaccagtaaggcgcatatcaacggttcgaccacgctctacaccacctattcccatctgctgaccgctcaggaagttagcaaagagcaaatgcagatccgcgatattctggcgcgtccggcgttttatctcaccgcctcgcagcaacgctgggaagaatacctgaagaaagggttaaccaatccggatgcgacgccggaacagacgcgcgtcgcggtgaaagcgatcgaaacgctcaacggtaactggcgctcaccgggcggtgcggtgaaatttaacaccgttacaccgtcggtgaccgggcgctggttctccggcaatcagacctggccgtgggatacctggaagcaggcgtttgcgatggcgcatttcaatccggacatcgccaaagagaatatccgcgcggtcttctcctggcagatccagcctggcgatagcgtgcgtccgcaggatgtgggctttgtccccgacctgatagcgtggaaccttagccccgagcgtggtggcgatggcggcaactggaacgaacgtaataccaaacccagccttgccgcctggtcggtgatggaagtgtataacgtcacccaagataaaacctgggtggcagagatgtacccgaaactggtggcctatcacgactggtggttacgtaaccgcgatcacaacggcaacggcgtgccggaatatggcgcgacccgcgacaaagcccacaacactgagagcggcgagatgctgtttacggtgaaaaaaggcgataaagaagagacgcagtctgggctgaacaactacgcccgcgtggtggagaaaggccagtacgacagtctggaaattccggcacaggttgctgcatcgtgggaatcggggcgtgatgatgccgccgtctttgggtttatcgacaaagaacagttggataaatatgtcgctaatggcggcaaacgtagcgactggacggtgaaattcgccgaaaaccgcagtcaggacggaacgttgctgggctactcgctattgcaggagtcggtggatcaggccagctatatgtacagcgataaccattatctggcggagatggcaaccatcctcggtaagccagaagaggccaaacgctatcgccagttggcacagcagctcgcggactacatcaacacctgtatgttcgacccgactacccagttctactatgacgtacgtattgaagataaaccactggcgaacggctgcgcgggcaaaccgattgttgagcgcggtaaagggccggaaggctggtcgccgctgtttaacggtgcggcaacgcaggccaatgccgacgcggtggtgaaggtgatgctcgatcctaaagagttcaacacctttgtcccgctgggaacggcggcgttaaccaatccggcttttggcgctgatatctactggcgtgggcgcgtatgggtggatcagttctggtttggtctgaaagggatggagcgttacggttatcgtgatgatgccctgaagctggcggatacgttcttccggcacgccaaagggttaaccgccgatggaccaattcaggaaaattacaacccgctgacaggcgcacagcaaggcgcaccaaatttctcctggagtgccgcgcatttgtatatgttgtataacgattttttccgtaagcaataatttgcaactgctggcggatgcggcgtaaacgccttatccgccctacatgtgcaatcctcctggccggataaaacgcggcaagcgttgcatccggcaactgcaccgcgccactggcggatgcggcgtgaacgccttatccgccctacatgtgtgttcccgtaggtcggataagacgcgacaagcgtcgcatccggcatctgcaccgcgccactggcggatgcggcgtggacgccttatccgccctacatgtgcaattccgtaacctggataaaacgcgacaagcgtcgcatccggcgttatcaccgggcgtattctttttgaatcccatcacaaaccccgcactccccttttcccttttctccggcgacggctaaattagaactcatccgaccacataacaattattttacatactggacaattttatgagctacccgtcgctgttcgccccgctggatttaggttttaccacgttaaaaaaccgcgtgttgatgggctcaatgcacaccgggctggaggaatacccggacggtgccgagcggctggcagcgttttatgccgaacgcgcccgtcacggcgtggcgctgattgtcagcggcggcattgcaccagatttaacaggcgttggcatggaaggtggcgcaatgctcaacgacgccagccagatcccacaccatcgcaccattaccgaagcggtacatcaggaaggcggcaaaatagccctgcaaattttgcataccgggcgctacagctaccaaccgcatctggtcgccccgtccgcattgcaggcccccatcaaccgtttcgtgccccatgagttaagccatgaagagatcctgcaactgatcgacaatttcgcccgctgcgcgcaactggcgcgggaggcaggatacgacggtgtagaggtgatgggttccgaagggtatttgatcaacgaatttctgacgctgcgcaccaatcagcgtagtgaccagtggggcggcgattaccgcaaccggatgcgatttgccgtagaagtagtgcgtgcggtgcgcgaacgcgtcggcaacgacttcattattatctaccgactgtcgatgctcgacctggtcgaagacggcgggacttttgccgaaacggtagagctggcgcaggccattgaagcggcgggcgcgaccattatcaacaccggcattggctggcatgaagcacgtattccgaccattgccacgcccgtgccgcgcggcgcatttagctgggtcacgcgcaaactgaaaggccacgtctcgctgccgctggtaaccaccaaccggattaacgatccgcaggttgccgacgatattctctcgcgcggcgatgccgatatggtatcgatggcgcgaccgtttcttgctgatgcggagctgctgtcaaaagcgcaatcgggacgagccgatgagatcaacacttgtattggctgcaatcaggcctgtctcgatcaaatcttcgttggcaaagtcacctcgtgcctggtgaatcctcgcgcctgccacgaaaccaaaatgccaatccttcccgccgtgcagaaaaaaaatctggcggtggtcggtgcgggacctgctgggctggcgtttgccattaacgcggcggcgcgtgggcatcaggtaacattgtttgacgctcatagcgagattggcgggcagtttaatatcgccaaacagatccccggcaaagaggagttttacgaaacgctgcgctattaccgccggatgatcgaagtgacgggcgtgacgctaaaactcaatcacaccgtgacggcggatcagttacaggctttcgatgaaacgatcctcgccagtgggatcgtgccgcgcactccgcccatcgacgggatcgatcatccgaaggtattgagttatctcgatgtactgcgcgacaaagcgccggttggcaacaaagttgccatcatcggttgtggcgggattggttttgatacggcgatgtatttaagtcagccgggcgaatccaccagccagaatatcgccgggttctgtaatgaatgggggatcgacagtagcctacaacaggctggtggcttaagcccgcagggaatgcagatcccccgtagcccacggcagattgtgatgctccagcgcaaagccagcaaaccaggacaggggttaggcaaaaccaccggctggatccatcgcaccaccctgctctcgcggggtgtgaaaatgatcccaggcgtaagttatcagaagattgacgatgacgggctgcatgtggtgatcaacggcgaaacgcaggtattagcagtggacaatgtggtgatctgcgcagggcaagagccaaaccgcgcgctggcgcaaccgctgattgatagcgggaaaacggtgcatttaattggcggctgcgatgtggctatggagctggacgcacgacgggcaattgcccagggaacacggctggcgctggagatttaaatcgttatttgaagcgccggatgcaacgcatccggcacgtcgcgttaatcaataaacaaggcgggagaaatgccgaatcgcgttgccaattttttagcgtgttccagcgttaatttcctcttcccgctcaaaacgcgtgacaccatagatttactgccaatttccggcagatcggaaagggttaaaccatattgatccataagggtacgaatcacggctataccgccaggcatggcttgagccatggcattaaattccgcaaattcgggcgctgattcttcccacgcggttattttggcacacaccagatccagcaaggggttttcaggatcgttgagcagcagatgatctaccagttccagcgcctgggtgtattgttcctcgttctgaatacccgccagaaaaggtgccacagcagttagcttttctcctgcttgcaagatgtcggcaatcgcaatcattttttccccttagtacgatgaacagcggtaaagaaatcgtattctttatgcgtcataacttcacgtatgtagcacttttgcgattcaaaaaagaccattgctacaacacgtaattcattgcccccaacattgaaaacataatgcttatccagatatttgaagttatccagagatgggaatactgcttttaatgactcaggttttttgaaatatcccttagcaatcgtgttccccagagccaccaactccgttttatgttgcgggtatttttccgcagcatctttcaatgctttttgagttatcaggtgcattcttcatcacgtccgttgacaaattggcaatatgataacatccgttgccagattggcaacggatgaatttatctgtgtgacggaagaataaacgtagaaaaacgctaaacaagagaatgtagacgatggtgacagggattttttgttttatggaagcgcgattccagaactgggcagacattgccggatgcgacgcttgccgcgtcttatccggcctggagtaacgtgctgaacgtaggccggataaggcgtttacgccgcatccggcaggtaactcccaatcttaccgacgacgtcccagcttcaccgctttcagtaccacaaatttattattcgtcgcaatagtggtgcagttgccgaaaatcttcttcagtttatggaagtaatccaggtgacggttggcaacgatatacagctcgccgttgattttcaggcagcggcgggcgtggtggaacatctcccaggcgacgttatcggtcagcgcatgttgttggtgaaacggcgggttgcagagcacagcattaaagcggaaaggctccacgccggagagcgcgttgttgatcataaactcgcagcgatccaacgcctctggcatgttggtttcaacgttcaaacggctggaagcaaccgccatcggcgattcatcgacaaacaccactttcgcctgcgggtttttatcaagcagcgtcagaccaataacgccattaccgcaaccgagatcgacaatctccccttcgagattctctggcagatgttgcataaagaagcgcgcgccgatatcaagcccggtgcgggagaagacattcgcatggttgtggatagtccagtcagtaccttccagcttccagctaacggtctgcggcgcatcggccagctgcggttcattgaaagtgcaattaatcaggcgcgcttttttccatgccagcgtggtggtggttgggccgagcactttttcgaacagttccagcgtggaagtgtgaatgtcacgggccttggcaccggcaataatacgtgtatccgacgtgaccactttgcgcagcgcacgcagttgctgttccagcaatgccagtgttttcggcactttgatcagcaccacacccggctgttgcgggtagtcggcggtgctgtcgagaaacttcacgctcgactcatcaatcccgttgaggcgtaaattctcgcgcgtcgccagttcactgatgtatgagtcgccaatgctgtacggcttatgttccgccagtgcgcagcttaacgcaccaaaggcatcattcaggatcaacaccgggccgcggatttctgtgtcgtccaactgttgcagcaaatattcatccgccgcttcccacgcctgtagcgggttaacgtcatccgtcgccggaaaacgttgtagtgtcagtgaacggaaaccgttgtctaagtggctcatcggccctcctgaatgataaaatttcgacattgcccctgaaaagggtgcgtgagtataccctttttctctttttcgtgggcggttatgagcaatcttacttatcttcagggttatcccgagcagctactttcccaggtgcgaacactgattaacgaacagcgtctgggcgatgtgctggcaaaacgctatccgggaacacacgactacgccaccgataaagccctctggcaatatactcaggatctgaaaaatcagtttctgcgtaatgccccgccgatcaataaagtgatgtatgacaataagatccatgtgctaaaaaacgcgctcgggttacataccgctgtttctcgtgtgcagggcggcaagctgaaagcaaaggtggagatccgcgtcgctaccgtgtttcgcaacgcgccggaaccgtttttgcgcatgatcgtggtgcacgagctggcgcacctgaaggagaaagagcataacaaagcgttttaccagttgtgttgtcatatggaaccccagtaccaccagcttgagttcgacacccgactgtggctaacgcagttgtcgcttgggcagaacaaaatctgaaaatgatgtcaggcgttatcttttctttctttagcgcctaaaatcgacctcccccctttcgttaaggataacgaccatgctgcgcgcatttgcccgccttcttctccgtatttgtttttctcgccggactctaaagattgcctgcttactgttacttgtggcaggagcgaccatccttatcgccgatcgcgtaatggtcaacgccagcaaacagctgacctggagcgatgtcaacgccgttccggcgcgtaacgtgggtttattgctgggggcgaggccgggtaatcgctactttacccgacgtattgataccgcagcagcgttgtaccacgccggaaaagtgaaatggctgctggtaagtggcgataacggacgtaaaaattacgatgaagcatcaggtatgcagcaggctttgatcgctaaaggcgtaccagcaaaagtgatcttctgcgactatgccggattctcaacgctggattcggtagtgcgtgccaaaaaggtttttggtgaaaaccatatcaccattatctcgcaagaatttcataatcaacgcgccatctggctggcaaaacagtacggcatcgacgctatcggttttaacgcgccagacctcaatatgaagcacggtttttatactcaactgcgggagaaactcgctcgtgtcagcgccgtgattgacgccaaaatcctccatcgccagccgaaatatctcgggccttcggtcatgattgggccgtttagtgagcatggctgtccggcgcagaaataatgcgtatctgcgcacgtcgaagatgaaaaaggcgtgctacattgacgacagaatccctttatggagtatccacgcgttatgatacgtttcgctgtgattggtacgaactggatcactcgccagttcgtcgaggccgcccatgagagcggtaaatacaagttaaccgccgtatattcccgcagccttgaacaggcccagcacttcgccaatgatttttctgtcgagcatctgtttacctcgctggaagcgatggcggaaagcgatgccattgacgcggtgtatattgccagcccgaattccctgcatttttcccagacacaacttttccttagccataaaattaatgtgatttgcgagaaaccgctggcgtcgaatctggcggaagtggatgccgccattgcctgtgcgcgggaaaatcaggtggtgctgtttgaggcatttaaaaccgcctgcctgccgaactttcatttgttgcgccaggcgctgccgaaagtcggcaaactgcggaaagtctttttcaactattgccagtattcctcgcggtatcaacgttacctggatggtgagaatcccaacacctttaatccggcattctctaacggttcaattatggatatcggtttttactgtctggcgtcggcggtggcgttatttggtgagccgaaaagcgtgcaggcaaccgccagtttgctggcaagcggcgttgacgcccagggcgtggtggtgatggattacggtgatttcagcgtcaccttgcagcactcaaaagtcagtgattctgtcctggcgagcgagattcagggcgaagcaggatcgctggtgattgaaaaactgtctgaatgccagaaagtgtgcttcgtgccgcgtggcagccaaatgcaggatctcacccagccgcagcatattaataccatgctctacgaagcagagctgttcgctaccctggtggatgagcatctggtggatcatccagggctggcggtcagtcgcatcaccgccaaactgctgaccgagatccgccgccagactggggtgatttttccggcagatagcgtaaaactataattgccaaagtaaaacagtgtaaaaggtatgtaacagaccattgactggctgaatggtctgtcatactttgttacctgcaaaggggagtaacttcattgccggtcgatcgtcattacgatgtgtgaaaaaacacatccggtcaccgggcaacccgaaaggaatacgcagacgtattccttttttgttgtaagtgagaccttgccggaaggcgaggtctatgcataaaaagcagcggctgacgtcttccgacgttggccgtttttttatgtgtaaggaacttctatgaatactgtcggcacgccgttgctatggggcggattcgctgttgttgtcgccattatgctggctatcgacctgttgttgcaggggcgtcgtggggcacatgccatgaccatgaaacaggctgcggcctggtcgctggtctgggtgacgctgtcgttactgtttaacgccgctttctggtggtatctggtgcaaaccgaaggtcgcgccgttgccgatccacaggcactggcctttctcacaggttatctgattgagaaatcgctggcggtcgataacgtctttgtctggctgatgttgttcagctatttctctgttccggcggcattacaacgccgcgtgctggtgtatggcgtgctcggggcgattgttctgcgtaccatcatgatcttcactggcagctggctaatttcgcagttcgactggatcctgtatatcttcggtgccttcctgctgtttaccggcgtgaagatggcgctcgcccatgaagatgaatcaggcattggcgacaagccgctggtgcgctggctacgcggtcatttgcgcatgaccgacaccatcgacaacgagcatttctttgtgcgtaagaatggattgctgtacgccacaccgctgatgctggtactgattctggtggaattgagcgacgtgattttcgccgtggatagcattccggctatcttcgccgtgaccactgacccgttcattgtgctgacctcaaacctgtttgcgatcctcggcctgcgtgcgatgtatttcctgctggcgggcgtagcagagcgtttctcgatgctcaaatatggcctggcggtgattctggtgtttatcggtatcaagatgctgattgtcgacttctaccatattccaatcgccgtctcgctgggcgtggtgtttggcattctggtgatgacgtttattatcaacgcctgggtgaattatcggcatgataagcagcggggtggataatttttaatctgcctaagccgtgtaccctgtcattaacatgagcaccgttttctccctctcccttccagggagagggtcggggtgagggtaatttttcgcaccgatgctggcctgttcccctcaccctaaccctctccccaaacggggcgaggggactgaccgagtccttttttgatgttgtcatcagtctggaagccgcacgttggctttatttttatgtcaaagaaatgtaaccattaagtttcaaaatatgacctctctttaaaatccagcatttttcgcttcccgaagctgtaactttccttatactcgaccttgcaaacactttgttacatcctgaaagatgcgtcgacagaacgcaccagggatgtgcgacaacacaatgaaaggatcgaaaaatgactacgcaacgttcaccggggctattccggcgtctggctcatggcagcctggtaaaacaaatcctggtcggccttgttctggggattcttctggcatggatctcaaaacccgcggcggaagctgttggtctgttaggtactttgttcgtcggcgcactgaaagccgttgcccccatcctggtgttgatgctggtgatggcatctattgctaaccaccagcacgggcagaaaaccaatatccgccctattttgttcctctatctactgggcaccttctctgctgctctggccgcagtagtcttcagctttgccttcccttctaccctgcatttatccagtagcgcgggtgatatttcgccgccgtcaggcattgtcgaagtgatgcgcgggctggtaatgagcatggtttccaaccccatcgacgcgctgctgaaaggtaactacatcgggattctggtgtgggcgatcggcctcggcttcgcactgcgtcacggtaacgagaccaccaaaaacctggttaacgatatgtcgaatgccgttacctttatggtgaaactggtcattcgcttcgcaccgattggtatttttgggctggtttcttctaccctggcaaccaccggtttctccacactgtggggctacgcgcaactgctggtcgtgctggttggctgtatgttactggtggcgctggtggttaacccattgctggtgtggtggaaaattcgtcgtaacccgttcccgctggtgctgctgtgcctgcgcgaaagcggtgtgtatgccttcttcacccgcagctctgcagcgaacattccggtgaatatggcgctgtgtgaaaagctgaatctggatcgcgatacctattccgtttctattccgctgggagccaccatcaatatggcgggcgcagcaatcactattaccgtgttgacgctggctgcggttaatacgctgggtattccggtcgatctgcccacggcgctgctgttgagcgtggtggcttctctgtgtgcctgtggcgcatccggcgtggcgggggggtctctgctgctgatcccactggcctgtaatatgttcggtatttcgaacgatatcgccatgcaggtggttgccgtcggctttatcatcggcgtattgcaggactcttgcgaaaccgcgctgaactcttcaactgacgtgctgttcactgcggcagcttgccaggcagaagacgatcgtctggcaaatagcgccctgcgtaattaattgtttaacccctttcgtctacggcggaaggggttttctcaactttaaacggatcaattccccttttctgcatccgccagaaacgaatgatattcaggccattcataagcagaaaactaccctcaatcatcgtgccgcctatcgaccccgcccagaagttgtgaatcacccagcaacacgttgaaaaccacattacgcagcgcatggtcagccctttacagcagaatagcgcccaggtactgacaatcgtgccgataaccggcaatagttcgacaggatgatggaacttcgcgaggccaattccgccagtcagcacaataaaaatcgccattacccataagctgcgcgtgcgtaaggtaatcaatgtacgaatggcattaaggatggcactggcaccagcgggataggtgcccagaagaaaaaaatgtacgccaataacggcgctatagaccgaaagctgctttttgaagcgacgttcgtcacgattgaaaaatgttgtgataccaatcagaaaggcgatgacacccacgccctgggccagccaatacgcggtcatgataaatccttagcaggtatggaaaagcaaacggcgcttcacattatgaaacgccgttttttattaacaactcatttcgactttatagcgttacgccgcttttgaagatcgccagttcgcggaagtcgttacgctcgttacaggtttgcttaccgttggcaaactcaacgatggtgtcgataaattcttccagcaactgcggcatcgctttaccgtggatcaactgacccgcgtcaaagtcgatccagtgttttttcttcgccgccagttcactgttggtggcgattttcaccgtcggcacaaatccaccatacggcgtgccacgaccagtactgaacagcaccatatggcagcccgcacccgccagggcgctggtcgctacggcatcgttacccggcgcacttaacaagttcagccctggcgttttcagacgctcgccgtaacgcagcacgtcaaccacgacgctggaacccgctttctgggtacagccaagtgatttgtcttccagcgtggtgataccgcccgctttgttccccggcgatgggttttcatagatcggctgatcatgggcaataaagtactgtttgaagtcgttgaccatggtgaccagtttttcaaacgttgcttcgtcgcggcaatggtccatcagcaactgctctgcgccaaacatctccggcacttcggtcagtacggtagtaccgccgttagcaatcacgtagtcagagaaacgccccagcatcgggttagcagtaataccagaaagaccgtcagaaccaccgcactccagaccaaacttcagttcgctgagtttgcctggctcgcgtttatcgttgcgcatcacgttatacagctgatgcaaatgctcgattccggcttcgatctcatcatcctgctgttggcagatcatgaaatgaacgcgttcaggatcgatatcgcccagcgtttcacggaatgcggcaacctggttgttttcacagcccagaccaatcaccagcactgcgcctgcgttcgggtggcgcaccatgttttgcagcatggtgcgggtattaatgtgatcgtcgcccagctgtgagcagccgtaggtgtggctgaagaggaacacgccgtcagtaccttcggcgttgttggtctctttcagaaaacggttctggatctgccgcgcgatgccgttgacacagcccacggttggcaggatccacagctcattacgcaccccgacatcgccgttagcgcgacgatagatctgcacttcacgatctgccgcttgcgcaggcagatcctgaaaatcaggttgatagcgatactgatccagatcgctcagattcgtgcgcgtattgtgggcgtgaacgtgaacacctgccgcaatatccgccaatgcataaccaatcggcaggccatatttgatgacattggccccttttgcgatatccgttaacgcaaatttatgtccacgagcaacatcctggcgcagcgtaacagtctggttatcgacactgacttctgtgccttcagccaaatctgctaaagcgaccgcgacgttatccagcgcatggatcttgatgtattgcatatcaaccccagaccttagttcagttcaatggcgaagtagtcacgcgcattgttaaagcaaatatttttcaccatctcgcccagcaggttgatgtccgccggtgcttcgcccgcttccacccagcgaccgatcatctggcacagaatgcggcggaagtattcgtgacgggtgtatgacaggaagctacggctgtcagtcagcataccgacaaagcggctcagcagaccgagctgcgccagttgggtcatctgacgttccataccgtctttctgatcgttaaaccaccagccggaaccgaactgcattttgcccggcataccttcgccctggaagttaccgatcatggtgcccagcacttcgttatcgcgcgggttcaggcagtacagaatggttttcggcagcaggttttcttcattctgcttgctcagcaacttagacagctcttccgccatcggacggtcgttgatggagtcaaagcctacatccggccccagcagtttgaactgacgcaggttgttattacgcagcgcgccaatgtggtactgctgtacccagccgcgacgtgcatattcggcaccaaggaacaccagtaccgcagttttgaactgcgccacttcgtgctcgctcagggtttcgccagccagacggcgcgccagaatgctgtccagttccgcttcgttcgcttcagcaaacatcaccacatccagcgcgtggtcagacactttacagccgtgagcggcgaagtgatccagacgtttggtcagggcagtttgcaggtcagcaaagcggcgaatgtcggtatcggaaacttcgcccagcttcgccatgtagtcgttaaaggtcgcctgttcgatgttgaaggctttgtccggacgccagctcggcagcactttgatggtgaaagagccgtctttggcgatctctgcgtgatgctccagagaatcgatcgggtcatcggtggtgccgaccattttcacgttcatctgctgcatgatgccgcgcgcggagaagttatcctgcgccagcagttcgttacattcgttccagatttcatcggcagttgacggagaaagcaatttgccagtgataccaaacggacggcgcagttcgaggtgcgtccagtggtataacgggttgccgatagtgtgcggaacagtcgccgcccaggcgtcaaatttttcacggtcagacgcatcaccggtacacagacgctcggccacaccgttggtacgcatagcgcgccatttgtagtgatcgcctttcagccagatgtcatacaggtttttaaaacgatagtcttccgcaatctgctgcggcggcaaatggcaatggtaatcgaaaatcggctggtcttttgcgtagtcgtgatacagacggcgggcaaattcggtatctaacaggaaatcttcagtcataaacggagtcattttcgtcttcctctcaacgagtgagctagcttgcttatggtgcgatgctgacaaagttatcacaccaatttccagagtccgaagatattttcgtgagttagatcaataaacgtagttaaaaaaattactctcaaagtggtaaatctcgctgcaggccgcgccagtactggccttgctgtcgtcaggtaatgtccctacaaatattcccacatttgtgatggctctcaccttttaaagttgtatgacaagttatctttctgccgtcgcaaatcataagtcgacggaatgcaaattgccgattcattcatttgttagatgaatcgggttaaccggtacggaagccgaattagcacgaaactttcatggcaacgttcggggcgtgccggttttttttcggttacccggtcgtaactaacatcttcagcctctggcgggatgatggccgcgcttcctgcggatataacaaaacgatgaggttttacatgcgtaaaattaaagggttacgttggtatatgatcgcactggtgacgctcggcaccgtgcttggttacctgacgcgtaacactgtggcggcagctgcgccaactctgatggaagagttaaacatctccacccaacagtattcctatatcatcgcagcctattctgctgcttatacggtcatgcaaccggtagcaggttatgtactggatgtgctgggtacgaaaatcggttatgcaatgtttgctgtgctgtgggccgtgttctgtggtgcaaccgcgctggcaggtagctggggtggcctggctgttgctcgtggtgcggtcggtgccgcggaagcagcgatgatcccggcgggtctgaaagccagctccgaatggttcccggcgaaagagcgttccatcgcagtaggctactttaacgtaggttcttcgattggtgcgatgattgcgccgccgctggtggtatgggcaatcgtaatgcacagctggcagatggcatttatcatctccggtgcattgagctttatctgggcgatggcatggctgattttctataaacatccgcgcgaccagaagcatctgaccgatgaagaacgcgactatattattaatggtcaggaagcccagcaccaggtgagcacggcgaagaaaatgtccgttggtcagatcctgcgtaaccgtcagttctggggtatcgcgctgccgcgtttcctggcagaaccggcctggggtacttttaacgcgtggatcccgctgttcatgtttaaagtttacggctttaacctgaaagagatcgcgatgttcgcctggatgccgatgctgtttgctgacctcggttgtatcctcggtggttacctgccgccgctgttccagcgttggtttggtgtgaacctgatcgtttcccgtaagatggtcgtaacgctgggtgcagtgctgatgattggcccgggtatgatcggcctgttcaccaacccgtatgtcgcaattatgctgctgtgtatcggtggttttgcccaccaggcactgtctggcgcgctgattacgctctcttccgatgtgtttggtcgtaacgaagtggcaacggcaaacggtttaaccgggatgtccgcatggctggcaagtacgctgtttgcgctggttgtcggtgcactggctgacaccatcggcttcagcccgctgttcgcagttctggcagtgttcgacctgttaggtgcgctggttatctggaccgtgttgcagaacaaaccggcgattgaggtggcgcaggaaacacataacgatcccgcaccgcaacattaacgtttcgtgtaagttttagtttcccttcaaagccgccttctcaggcggctttttcatcactgcgagtagagctaaactcgcaaaagtggtataacaaatatagtctgccgtatcatgcctggagcgcatatggaaatcactgaaccacgccgtttgtatcaacaacttgccgctgacctgaaagagcgcatcgaacagggcgtctatctggtgggtgataaactgcctgcagaacgctttattgccgatgaaaagaacgtcagccgtacggtagttcgtgaagccatcatcatgctggaagttgaaggctatgtcgaagtgcgtaaaggttcaggtattcatgtggtttccaaccagccgcgccatcagcaggcggctgacaataatatggaattcgccaattacggtccgtttgagttgcttcaggctcgccagctcatcgaaagtaatattgccgaattcgcggcaactcaggtaacgaaacaggacatcatgaaactgatggccattcaggaacaggcgcgcggcgaacaatgcttccgtgattccgagtgggatttgcagttccacattcaggtcgctctggcgacgcagaactccgccctggcggctatcgtggaaaaaatgtggacccagcgtagtcataacccgtactggaaaaaactgcacgaacacattgattcccgtaccgtcgataactggtgtgatgaccacgatcaaatcctcaaggcgctgattcgcaaagatcctcatgctgctaagctggcaatgtggcagcatctggaaaacaccaagatcatgttatttaacgaaaccagcgacgacttcgagttcaatgccgaccgctatctattcgccgaaaacccggtggtgcatctcgatacagccaccagcggcagtaaatgaaattcctgtccgacaggcgctgcaatgcgcctgtttgtctcgtcggtaagcgaaaagtataaagtgtcagcctgtgtaaatcctctcgccaccctcccctgcattcagcaaaatcagactccacggacatgtaattttgataacgaacaacgttgacctttgttacaattagattcaatttgaatttatgtttttgaatgctttcttatctcacgatttaacagggaatagttcaggctgtgttgatgtatcaaacccgcagaacataccaaaacagcaataacattgcggtagtgcatcttttaaaaccagcgtggcgttaaccgattcaccaggaataatgaatggaacttttgacccaattgctgcaagccctgtgggcgcaggattttgaaaccctggccaatccatcgatgattggcatgttgtattttgtcttgtttgtaattttgttccttgaaaacggcttgcttccggcggcctttttaccgggcgacagtttactggtattggtcggcgtgttgattgcgaaaggcgcgatgggctatccgcaaacgattctgctgctgaccgttgccgccagcctcggctgctgggtcagctatattcaggggcgatggctgggcaatacccgcaccgtacaaaactggctatctcatttacccgcgcattatcatcaacgcgcacaccatctttttcataaacacggtttatcggcgctgttaattggtcgctttattgcgtttgtcagaacactgctgccgacgattgccgggttatcagggctgaataacgcgcgctttcagtttttcaactggatgagcggtctgctgtgggtattgatcctgacaactctgggttacatgctcggcaaaacgccggtatttttaaagtacgaggaccagctgatgtcatgcctgatgctgctcccggtggtgctgctggtgtttggcctggcaggttctctggtcgtgttatggaaaaagaaatatggaaatcgggggtaagggatgcaaatacctcgcatgtcgcttcgccagctagcctggtccggcgctgttttacttctggtcggcacgctgttgctggcctggtccgcggttcgccagcaagagtctacgctggcgattcgtgccgttcatcaaggcacaacgatgccagacggtttttcaatctggcatcaccttgacgctcatggcattcctttcaaaagtatcacccccaaaaacgacactctgttaattacatttgactccagcgaccagagcgccgccgcaaaagcggtcctcgacagaacattgccccatggctacatcattgcgcagcaggacaataacagtcaggctatgcagtggctgacccggttacgggataactctcatcgcttcggataacttcctgttatccgaaacatatcactcactttggtgatttcaccgtaactgtctatgattaatgaggcggtggttaacactaccgcttcgttgtctggacaatcgttcctttgtaataggtccgaatcacaatggaaggttcaagaatgaaataccgcatcgctttagctgtttctctctttgctcttagtgccggtagttatgccactaccctgtgtcaggaaaaggagcaaaatatccttaaggagatcagctatgccgaaaaacaccaaaaccagaatcgtattgacggtctgaataaagccctgagtgaagtccgggccaactgttcagatagccagctgcgtgccgatcatcagaagaaaatcgcaaagcagaaagatgaggtggcggaacgccagcaagatttagccgaggcgaagcaaaaaggcgatgccgataagattgccaaacgcgaacggaaactggcagaagcgcaggaagagctgaaaaagctggaagcgcgcgactactaactcacaatagtcactacttactcacctggagaaaactatgtcgaaagaacacactacggaacatctgcgtgctgagttgaaatccctttccgatacgctggaagaggtgcttagctcatctggcgagaagtcgaaagaagagttgagtaagattcgtagcaaagcggagcaggcactgaaacagagccgttatcgcctgggtgaaaccggtgatgccattgccaaacaaacccgtgtcgcggcggcgcgtgccgatgagtatgtgcgcgaaaatccgtggacgggcgtgggcattggcgctgcaatcggtgtagtgctcggcgttctgctgtcgcgtcgttaattatggcggacactcatcacgcacaagggcccggtaaaagcgttctgggcatcgggcagcgaattgtttctatcatggttgaaatggtagagacacgtctgcggctggcggtggtggagctggaagaggaaaaagcgaatctctttcaacttttactgatgctgggcctgacgatgcttttcgctgcatttggtcttatgagcctgatggtgctaattatttgggcggttgacccgcaatatcgcctgaatgcgatgattgccaccaccgtggtgttgctgctactggcactgattggcggtatctggacgctacgtaaatcgcgtaagtctacgttgctgcgccatacacgccatgagttagcaaacgatcggcagctgctcgaggaggagtcccgtgagcagtaaagtcgaacgtgaacgacgtaaggcgcaactgcttagccagatccagcaacaacggctggatctttccgccagtcgtcgtgaatggctggagacaacaggcgcttacgatcgtcgctggaatatgctgctaagtctgcgctcctgggcgctggttggcagtagcgtgatggcgatctggacgattcgccatcctaatatgctggtccgctgggccagacgcggttttggcgtatggagcgcctggcgtctggttaaaacgaccctcaagcagcaacagcttcgcggttaacttccctctggccggagccattccggccttatccctcaaattttttgaagatttttgacagttttccttgctaacaatcatcattcaccacgtttatgattctctccatcgacagcaacgacgctaataccgcgccattgcacaaaaaaacaatcagcagcctgagtggcgcagtggagagtatgatgaaaaaattagaagatgttggtgtactggtagcgcgcattttaatgccgattctgtttattaccgctggctggggaaaaattactggctacgcgggtacccaacaatatatggaagcaatgggcgtcccgggttttatgctgccactggtgattctgcttgagtttggtggtggtctggcaatcctgttcggtttcctgactcgcaccacagccctgtttactgcgggctttacgctgctgacggcatttttatttcacagcaactttgctgaaggcgtcaactcgctgatgttcatgaaaaacctgacaatttctggcggattcctgctgctggcaattaccggtccgggcgcgtatagcatcgaccgcctgctgaataaaaagtggtaagcacgcgctatacttaacgataaaaaacgaggaggaagctcctcgtttttgctattggaggagagaaaaatgggtcaactgattgacggcgtctggcatgacacctggtacgataccaaatctaccggcggtaaatttcaacgttcagcttccgcatttcgtaactggctcactgccgatggcgctcctggccccactggcacaggcggttttatcgcagagaaagatcgttatcatctctatgtttcactcgcctgcccgtgggcgcaccgcacgctgatcatgcgcaaactcaaaggactggaaccgtttatttccgtttccgtagtgaacccgctgatgctggaaaacggttggacctttgatgacagttttccgggagcaaccggagacacgctctatcaaaatgaatttctgtatcagctttatctccacgccgatccacactacagcggacgagttactgttcccgtgctgtgggacaaaaagaaccacaccatcgtcagcaacgaatcagcagaaatcatccgcatgttcaataccgcgtttgatgcgctgggcgcgaaagcgggtgattactaccctccagccctgcaaacaaaaattgacgaacttaacggctggatttatgacaccgttaacaacggcgtgtataaagctggttttgccaccagccaggaagcttacgacgaggcggtggcgaaagtgtttgaatcgctggcacgactggagcagattttaggccagcatcgttacctgaccggcaaccagctaaccgaagccgatattcgcctgtggactacgctggtgcgttttgatccggtgtatgtgacccacttcaagtgtgataagcaccgcatcagcgattacctgaatctgtacggttttctgcgcgatatctaccagatgccggggatcgccgaaacagtcaatttcgatcatatccgtaatcattacttccgcagccataagaccatcaaccctacggggattatttcaattggtccgtggcaggatctcgatgaaccgcatggacgagatgttcgcttcggttaaaaaaaggcaccttacgaggtgcctctgataattagctaagtgcatgttgttcatgtcggatgtggcatgaacgccttatctgacatacaaaacattgtacattcaatagattgcataacccgcgcagaccagataagcgtagcgcatctggcgattttgcgcttgtcatcagtcttagcgcgccttcacggcactttattaattccttgaacgaatatttactgccatttcattcacgtctattcttaatttgctgctttaaaaacaagtgattgagcaaaattgaggcaaaaatggactggtatctgaaagtactaaaaaattatgtcggtttccggggtcgtgcgcggcgcaaagagtactggatgtttattctggtcaacatcatctttacgttcgtgctggggctgctggataaaatgttaggctggcaacgcgctggtggcgaaggcatcctgacgacaatctacggtattctggtgtttttaccgtggtgggcggttcagttccgccgcctgcacgacaccgaccgctcggcgtggtgggcactgctattcttaatcccgtttatcggctggcttattatcatcgtctttaactgccaggcgggtacgccaggcgaaaaccgctttggaccagatccaaaactggaaccttaaaacaaatctgctcgccggatgtctgactcatccggcttttatcattatgttgatgaatgaataatttactaatgtttatttaaaatatttcaatgtcgttatataaattacctataaaaaataaccatgtatttatcttaaatatcaaaacctttataacatccgaaaaagaaagatacgaatagcatttacacaatacccggaatagactttcgtcacttttaattaaagggatgtttttatgcagtggtatttgtccgtattaaaaaattatgttggtttctctggtcgcgcacgtcgtaaagagtactggatgtttactctgattaacgccatcgtcggcgctattatcaatgtcattcaattgattttaggtctggagcttccatatctgtctatgctttatttgctggcaaccttccttcccgtccttgcgcttgctatccgtcgcttacacgataccgaccgttcaggtgcctgggccttgctcttttttgttccgtttattggctggctcgtgcttctggtttttttctgcacagaaggtacttctggcagcaatcgttacggaaacgatccgaagtttggttcaaattaatcttagaattggggcgatatttcgcccctttttattaacaataataaatattattttccgttaaaaagtttgggaatttcccgcagacaccaggatttcgcttcccccatactgtcacgacgccaggccataataatatcgatctcgctggtcgattccgggctgacgacacgcaaccgcccttccgcaatatctttttcgaccataggatacggcatcgtcgccacgccaagccccgccagtaatgcctgacgtttatcttcaatcgtgctcaccgttaagcgcggctgtttgtccagcagctgtacggtcaacaccgggcgctcacgagcggtatccgccaccgcaattccacgatatttcacacgcgtcacttcagataacggttccggctcctgatgaatcgggtgatcaggcgcggcaacgtagacgttcattaacgtatagagcttgcgcgagttgatctccgacgaggaacgaaaatgcatatccggcgcgataacaatatccgcccgcccctgctccagccgttcccacgcccccgccagcacttctgtgatgattgccagttgggtattggcttttgccgccagtttgtcgattaacgggaaaaaggcaggtgtcggtaccagcgcttcggtcacaatggtgagatgcgtttcccaaccgcgcgcgagagcttccgcatcagtagtcagtttatctgcggcttccagcaaaacgcgccctcgctccaacaacatcctcccgacattggtgaatttggtacgatggcccgagcggtcaaacagcaccacatccagctcttcttccagtttttgcatggtgtagctaagtgcggaaggcacgcgtcccagctcatccgccgccgccgcaaaactgccccggcgatcgatcgcatccataacccgtagtgcttccagcgttaatgccctttctttggccatttcgttctcattcaggaaatttgaacataccgggcagaatatctggctaacaatgtagcgtccagccccttaccataaaaggaagtaaagagaggtcaagaattatgattactacccgaactgccaggcagtgtggacaagcagactacggatggttgcaggcccggtatactttttcctttggacactacttcgacccgaaattgttaggctatgcctccctgcgtgtgcttaaccaggaagtgctggccccaggtgccgcctttcagccgcgaacctatcccaaagtcgatattttaaatgtgattctggatggagaagcagagtatcgcgatagcgaaggcaatcatgttcaggccagcgccggagaggcgttgctgctctctacccagccgggtgtcagctatagcgaacacaatctcagcaaagacaaaccgttaacgcgaatgcagctttggctggacgcctgcccgcagcgagagaatccgctgattcaaaagctggcgcttaatatgggcaagcagcaattaatcgcctcgccagagggtgcgatgggaagcctgcaattacgccagcaagtgtggctgcaccatatcgtgctcgacaaaggcgaaagtgcgaatttccagttgcatgggccacgcgcgtatttgcaatcgattcacgggaaatttcatgcgcttacgcatcatgaagagaaagcggcgctgacctgcggtgatggggcgtttattcgtgacgaggctaacattacgctggttgccgattccccactgcgcgctttgctgatagatttgcctgtctagttgtttttacagggagatgatgatgagtaaaaaattggccaaaaagcgccagccggtgaagcccgtggtggcgaaagaacctgctcgcaccgccaaaaattttggctatgaagagatgttgagcgagctggaagctatcgtcgcggatgctgaaacgcgtttagccgaggatgaagctaccgcgtaaagacaggttgccggatgcggcgaaaacgccttatccggcctacaaaatccaacaacattaacgaattaaacaacccgtaggccggacaagatgcgccagcatcgcatccggcacgatccccaaaacctggcgtttatctggccttgctcgccataatctcgataatctgccgatccgtttgctgcatcgaatggcttgctaacgcacacaggttggcaatcgactgctcaacatcatgcgccacaatcccttcattgccggtcacggcggtatcatccagcgccattaacaccgctttccacgcagccgaagcactggtcgaaaccttcatcgcgcagctgttcgacgcaccatcgcaaatcatgccgctgacatcgccgatcatactgctgatcgccatcgagatggtttcataacgcccatccaccagccatgccatcccggcggcggcccccattgctgcggtcgttgcggcacacagcgcagacaaacgcggtaactggttatggatgtaaattgcgctcaaatgcgaaagcatcagcgcacgcgccagccgttcatcatccgctccgaagtgttctgctaccaccaccacaggcattgttgcggtaatcccctggttacccgagccggagttactcatagccggaagcgtagcgccgcccatacgcgcatcggatgccgcgctggtacgaatcacaatggatgaagagagatctttcgccagcaaaccgcgctcgcactgtttttccagcgtcgcgccaatatgcagcccccacttaccgctcaaaccttcctgcgataacgcacaatttagcttcgcggaatcgagaataaagcggatcgccgcaaacgggacttcattgacgaacttcaggatctcagccagcgtcgttctggaaagcaccgtcagcggagactcttgctcgccctctgccacacacgcctgctgggtaaacaccacaccatcgtgcgtctcgatatgcacaatgttggtatgcccgccgacgatggtgacacacgcccacttctcaccgttccagactttggcgcgtgagaagaggatttcatcgcaaggttcctggatcttaacggagactttccccgccgccagcagtgctttggcatcggcaattgcctgcgctgttgcgtctttcagcacttccagcccggcgttggcatttccacctaacgcccccagcgccgccgcaatcggcagccccaccattcccgtgccgggaacggtgacgcccagaccgttcttcatcagatttggcgaaacccaggcttctacacgttcaaccggaccttccagttctgccgcagcaaccgccgccgccagcgccagtgaaatcggttcagtacatcccagcgccggttttacttcctcctgaacggcgaggatgtaacgctgccataacggatttaaagtcgaatcaaacatattaaaaaccttaaaatttcaggtaaatcaagaaaatgccaggaacggagaaacacacagcaacaaaccagtgacgataatcaggtacagagacatccctttgtatttgtgcaatgctggtactttgtaaaccagccacgccgggatcaggcaccctaccatgccgaaaatcgggctacagatagaggtgaagctcaacaccggtgcgttcagtacgatggcgctccaggccagcaaaatggcgaaaatcatgatgccgcgctgaacgagattttcgttaatcttctcggcaggcatcttgcgacgcaggatgttcattacgatcccttgcgttgcttcgcgaaagcctaaatagacgccaaagaatgcagtcatgacagcaaagatattgagaatgacgctgaccactttcacccacgctgcgccgtcaccgctaataaactgtgcggcaatcgccagcgcggaaatattctgctcataggcttttaccgcttcgtcatgtcccatcgccagcgtgaacgacacggcgtagaaaaagacggtgacaaacaaaatgccaaacgcgatattcattgcccgcaatgctttatgccgcgccacttcaattgatttttcccgcgagcgataagagatcaccatcggacttaacgtctggataaacagaatcgacgtcagggtaaacggcagcgtaataatggcgtttttcaccagcagccccagcggcggtagcgaaccgacgttatacagatgccacattcccaccatcgacacgcccagcgccgcgaccaccagcagcttggtcagcaccatgccggtcgaaattttgaataacaatttctcgccgcgtgaggagatcgccaccagaatgcaaatcagtaccagaccataaaagggactgtctgacagcaacccttccgtcacgccgaaggtatgcaggtaggaagcactatcgttggtgatggcggtggaatagacgaacatccaaatcaccagcattacgaaatagagcgcacctaacaggatgccccagtttttacctaaataaccgctaatgacgctcgggtaatctttacattctggtgattctgccagcgtattaataaacaatcgctgaaacagatacattgccgggtaaccaatcaccgatgagagcaaaaatacccacaatcccatcaaaccgacctgcaccgggagaaaaacaatccccgcgccaatcgccatcccgatactcataatcacccagccggtgtcagtactgtcgaatttgatcgcttctcgccactcgctctcactcattccagcacgacccgccggggtcgaagcgtctgcaatgacgcctttattcgatgcaatttccataatttctcgctcaatattttgtagggcttattatttttttccgagccgcatcaaggcgatatgcggtctacgtttttgcaggcgagttattagaataaagaaatgatacgcgcgaggtcagagaaaatcttcacaatcaagactttgaaataacggagatggataagaattttctactaaattaatcgcaggagaatattcattctctatttgcggcagatcacaaaaaaaaggtgcacatttgtgcacccaaggatgaaagctgacagcaatgtcagccgcagaccactttaatggccagtcctccgcgtgatgtttcgcggtatttatcgttcatatctttgccggtttcatacatcgtctcgatcactttatcgagtgaaacacgcggtgccgaggtgcggcgcatcgccatccgcgcggcgtttactgctttcacggcattaatggcattacgttcaatgcacgggatttgtacctgtccggcaaccggatcgcaggtcagcccaaggttatgctccatcgcgatttccgccgcattgcatacctgcgccggactgccgcccagtagttcagttaaccctgccgccgccattgaacaggccacgccaatctccccctgacagccgacttccgcgccagagatggaggcgttcattttatacagcgcgccaatagcccccgcggccagaaaatagcgggcaattgaccgctcgtttaccggacgacggaacttatcgtaataagccagtactgccggaataatgccgcacgcaccgttagtcggtgccgttaccacgcgcccgccagctgcgttttcttcactaaccgccagcgcgtacatgttgatccagtcgatgacattcatcggatcgttagagatgttatcgctggaaaccagctgacgacgcagcgctacggcacggcgcggcacattgagcggaccaggcagcacgccttcagtgttcatcccacgttcaataccgtcatgcatcacttgccagatacgggcaaaaccggcgtcaatttccgctttgctgcgcagcgctagctcgttgtgcatcatcagaccagatatagacaggccgttgtaatcacacattttcagcagttcacctgctgagtggaaatcgtaaggtacggacgtttcgacatcgtgcgacaggccgaagtgttcttcttcgacaataaacccgccgccgacagagtaataggttttacttaatagctcttcctgtcccttccaggcagtgatccgcattccgttctcatggcgaggcaacatttcgggatggaagataatgttctttgctacaggaaaatcaacaatatgcgcaccagatgccactggcagccgcccgctgcgcgttactaactctataaatgcagggatctcatcaatgacaacatcctgcggactgtttcctgccagtcccatgatgatggcgacatccgtggcatggcctttgcccgtcagtgacaacgacccgtacagatcgaccacaatatggctcgtcgcggttaataagccgctactttccagccgatcaataaaactttttccggcattcattggccccacggtatgcgaactggagggaccaatcccaattttgaaaatatcgaatgcactaatcatatccacaccctcggattgccgttcagtgaagtggagcggaacgaccttacgaccgtcccgctcacgaggctttacgcactacgtactgcgatggcttcaatttccagcttcacatctttcggcaaacgcgcgacctgcacacagctccgggtcggataggtcgcctgatgctcatcgaagaactgcttatagacttcgttgatggtggcaaaatcattcagatcggtgataaacacggtcatcttgatgatatcgcccacgctcagcccggcagcaaccacgatcgctttgacgttttcgaggcttaaacgcgcctgatcttgcacatcagccgggatctcaccggtctgtgggcaaaccggtatttgcccggaggtgaagaccatgctgcctaaatcaacgccctgaacataagggccgattgcgcctggggcacgttgcgtttcgataatctttttcatacatcctccggcgtcagagcgcctgggtaaaggtacgtgaaataacatcctgttgctgttcacgggtcagtgcgttgaagcgcacggcgtagccagagacacggattgtcaggttaggatatttttccgggtgctcgatggcatccagcagcatttcccgattcattacgttgacgttgaggtgttgaccgccttcgacatccgcttcgtggtggaaatacccatccagcaggccgacaaggttggttttacgtactggatcttctttgcccagcgccgcaggaacgattgagaaggtgtacgagatcccatctttggcgtaggtgaacggcagtttcgccaccgacgtcaatgaggccacggcacctttgcggtcacgaccatgcatcgggttagcgcccggcgcgaacggtgttccggcgcgacgaccgtccggcgtattaccggttttctggccgtacaccacgttagaagtgatagtcagaatcgactgggtagggacggcgttgcgataggttggcagcgctttaattttcttcataaagcgttcaaccaggtcgcaggcaatgctgtctacgcgctcgtcgttgttgccgtactgcggatattcaccgtcgatttcaaagtccaccgccaggccgttttcgtcacggattggtttcacgcgggcatatttgatggcagacagggagtccgtcgccaccgacaggcccgcgatgccgcatgccatagtgcgatagacatcacgatcgtgcagcgccatcagcgaagcttcgtagctgtacttgtcgtgcatgtagtgaatgatattcagcgcgctgatgtactgcaccgccagccagtccatgaagtgatcgaggctgtccatcactttgtcgtaatccagcacgtcgtccatcagcggtgctgttttcggcccgacctgaatcttcagcttctcgtccaccccgccgttaattgcgtagagcagcgttttcgccaggttagcgcgtgcaccaaagaactgcatttgcttaccaatcaccattgggctgacgcagcaggcaatcgcgtaatcgtcgctgttgaagtcagtacgcatcagatcgtcattttcatactgcaaggaagaggtgacgatcgacacctgcgcggcatattttttgaaggcaatcggtaattcttccgaccaaagaatggtcaggttaggttccggtgccggccccatagtgtgcagggtgtgcaaatagcggaaggagtttttggtcaccagcgtacgaccgtccagccccatcccgccgatcacttccgtcgcccagattgggtcgccggagaacagcgaatcaaattccggtgtacgcaggaagcgtaccatacggatcttcatgatgaagtgatcgatcagttcctgtgcctgctgctcattgagtacgccagctttaaagtcgcgctcaatgtagatatcgaggaacgatgccgtgcggcccagcgacatcgcgccgccattttgcgatttcactgccgccagataagcgaagtagagccactgcaccgcttcctgcgcattctgcgccgggcgagagatatcaaagccatatttcgccgccatttcctgaatctgcaacagcgcatgacgatgctctgccagctcctcacgcagacggatggtggcttccagatcctcgcctttttccagacgagactggagatcggcaaattgcagttcgcgttcacgtaccagataactgatgccatacagcgctacgcggcgatagtcaccgataatgcgcccacggccatagccatctggtaaaccggtcagcacgccagatttacggcagcgcagcatatccggtgagtaaacatcaaatacgccctggttatgggttttacgcagatcggtaaacagatattcaaattcactgtccatttctcggccataggcgtggaatgaacttttaatcatattaatgccaccgaacgggtgtagcgcacgtttcaacggcgcatccgtttgcaggccaacaattttttccagcggctggttaatatatcccgcatcatgagcggtaattgtggtggcaatattggtatcgaaatcaaccggcgcgtgggttgcattttcgatacggatgccttccattactttttcccacaattccgtggtggcaggcgtcgcttcggcgaggaaagattcatcgccttcatacggtgtatagttatgttgaataaaatcgcggacattaatttcgtttttccagtccgtacctttaaagccaagccatgcgtcggcgtacagcttatcgctggtatcaatatctaccttcatgaaaaataatctctctacaatacttcaactaaattatgcaaattctgcgggcgcgttaactttgcctaaatgaatggcatccaaagcaatcattttttcttcgttagtcggaataacggcacaaatgacacgcgcattttcactggaaacaattcgctcaccacaggagttagagcgattattcatttctgtatcaatctctaagcctaatacagccaaatgttccatgaccagacgacgaattaagcttgaattctctcctattccgccggtgaatataattccatccaggcgacgtaatgaagctgcgtgtccggcaatatgacgggcaattcggtgaacaaaggttttaattgccagttgcgcgcgttcgtgaccttcatgccaggctttttccagaacacgtaaatccgaagaaagaccggaaatacctaataatcccgactctttattcactacgcgttccaggtcacccaggctctggttggtttggctggcgacccaggacatcgcaccaaagtcgacatcgccactgcgggtacccatcatcaagccttccagcggcgtcattcccattgaggtatcaacactctgaccgttgcgaaccgcgcagattgacgcgccattgccaagatgcgccacaaccaggccggagtcatcttccgccagattcagcagcgaatgtgcgcgctgggaaacatagcggtgcgacgtgccgtggaaaccataacggcgtacacctaactcttcataatatttccacggcaggccgtataaataagcttccggagccatcgtctggtggaaactggtatcaaataccgccacctgagttacgcccggaaataattgctgcgccgattcaataccacttaaattggcgtaattatgcaggggtgccagtggagaaacgcgacggatattatcaatgacttcatcggtaataatggcggactcggtaaaaatactgccgccgtgagcgatgcggtggccaattaaggccacactgtcatttaaattccgtttttccagttcaaatgcaattgccttcaatgcaccttcgtagctgtggtgagccagcggtgctggctctcccccatttacggataagaatgcattttccgagttaataccgtcggcaatacctgacattaatacttcacagtcgctggcatcgagcacggaaaacttaatcgaagacgaaccacagttaataaccaaaacaaccggaaattcattcatctcttttctcatcctgagttacggattaaaacagtttgtatacgatgttcaggatggtcagcagaccaatcacggtaacaaacacgttatccagacgaccacggtatttcgccagagacggcgctttacggatggcatacatcggcaacaggcacagcagggatgcgataatcggtgcgcccatggcttcaatcaggtcaaggatgttcgggttggcgtaggcaacaacccaggtggagcccatgatgaagatcatgctgatagtgttcagtttacccagcgacactttagttttgtcgcctttataaccaaacttcaggaccaggccattcagaccttccagcgttcccagatagtgaccgaagaaagatttgaagatagccacgagtgcgatgatggaagccgcatattccagtgtaatcgcgaacgttgttttggtaccggtcatggacgcaaagtggttagccagataagaaagcactggaatattctgcgctttggcttccgccatgttggccggagacagagtaaacaggcagctaaaggcaaagaacatcaccactgcaaccatcagcatgctggcacgagaaatgatttgggaacatttacgttcggtgaagtcgcgaccgaagtctttctcatactcttcacgcttagaaaccacgaaggaagagacgattggcgagaagttaaaggagaaaaccatgatggaaatccccagccagacagtgatcaggataccgtcatgaccggttaacgacagcgaaccgaggtcaacctggtcgataactgcagagttccagtaagggatcagcgacaaagaaatcagcaccaggctggcgataaacggccataccaggtagctcatcactttaaccatcagatccttaccaaaccagatgacgaaagccatcagcagcaacaggaacagcgccacaaagccgcgattcagcggtgcaaagccgagctggttttcccagaacgtcataaaggtattggtaatagtaacgccataaatccacagcagtgggcaaatcgcgaagaagtacaggaacgtgataaccacgccgccagttttaccaaaatgctcttccaccgtttccgtaatgttgccggaagggttagagccagaaagacacagacgcgccagcgcccggtggcaataaaacgcgatggggtatgccaataccaacatcagaagaatcgggatcagtccgccaaaacctgcgcggatagggaagaacagcaccccggcgccgattgccgtaccaaacaagcctaacgtccatgtggtatctgatttacgccaggacgattgttttgtctggctggatacaatgctatctgaagtactcatatcctatcctcaacgaattaattaagcgtcaacgaaaccggtgatttgagagacgcgagaaagatcgatattgccgccggaaataatactgacggtttttctgttttgaatatattggtctaatttaccgcttaataatgcagcacatgccagagcgcctgcgccttcggtgacgactttattgcgctgaattaaggcaatcatactgtttctgatttcgtcttcgctgaccagcacgatgtcatcgactaattcacgaacgatttcgtaagttaaattacccgggcgggagacatcacaaccatccgccagggtgccggtagttcggtgcgtggttatttctccggagtggaaagaagccgccatgccgtgaacgttttcagactgtacgccaataacacgaatggtcgggttaatagatttaattgccaccgcaataccagcaattaaaccgccaccaccaattggcacaatcacgttatcgacatcatagagatcttccataatttccagaccaatcgttccctggccagcaatcactttcggatcatcgtaaggtgggataaaaatacggccttccatttcgacaatttcgctcactttagcgatagtgtcgttgaagttatcaccatgcagaacgacttctgcggagtagtcgcacgttgccgctactttggattttggcgcaccttttggcatcaccactttaccgtcgatacccagcatcgcgcaggagagggaaaccccttgcgcatggttgcccgcagaacaggccaccacgcctttgcgtttttccgcatcggtcagtgaacttaatttattaaatgcgccacgaattttaaatgaacccgtacgctgcatattttcaaacttcaggaatatttcacctttgcaacgttcactaaaatagttggagcgaggcatgcctgttttataaattcgcccagccagtcgttgtttcgcttcaataatgtcatcaatagcaaccggcagatcgtatgtaatatgcattataaaacctcttcgcctgaattaaatatgtaggtaaccgtaaccgacacctgcaagacagacaggtggattatttatgtttaaataaaaacaaataactaaccaacttctattaattgccttcgtctacacccattataagatgaatactctttggctaattccaccaaaaccgatgctgcttttttaatacgataatttttcgaccataccgcggcatattgtgccacaggtaatgtttcttcaaccggaatagtaataaattgattagaaccaaaaggtgacgtcatatcacaaggaattacagttaagaaatcagcattgagaacaagattataaattgtcacgactgagtcggttttaacgatgttttcaatactgatgccatttctttgtaacgtagtaagcagttcgctgtagtaccccatattagtttgtggcaacacccactgttcgttcttcaacgactccagcgtggtggtgccggtgcatgttcgggacttactggctaccagcacaaactcggactcgaacagcggctcaacatgtaaatcctgaagcttcatttctgcacttaacgtaccaatcgcaaaatccagtcgaccgtcgcggattgccggtaagaacgaagacagttgcgcttcatacatagaaacctgcgctttcgggaacacctctttgaacttgttgatcatccctgacataaaagtaaaaccaatcaatgaaggaaaaccaaatgagacttccaccaccgcctcagaagacataccgcttatctcattaaccatatttttcatttcacgggtaatggattcggaacgggagagtaacaattgaccggcaggtgttaatgttacaccggtatttttccgcaccactaattccacaccaaaataatcttcaatatcgttaatgattttactgacggccggttgagttaaccctaattcttttgcagccgagccgatagaaccacttctaatgacttcctgaaagactaccaggtgctgcgttttcggaagaagaatagtgctcataacgacctacgttaattacctcattgacggcatgaagtgtatcaaaatgaaatgaacaggatatgtgcgaccactcacaaattaactttcaatactttccagagtatcgttattacaattaaatacctttaaatatcaacaagttaaagtataaaaatcagcataaaccctgatttttgtcaaaaaaaatgacggggataaccatattttatggcgataacatcattcgttatgtggttaatacaaaaaaggggctgagaccatatttcaagcaattaccggataattaccaggcaaaatttgagttaaatttaatgagcaagttctcaaattttattataaataaaccattttcagtgataaataatgcggcatgtcacattttttcacgctatttgttggagaacaaacatttattttatcaatattttaaaatttcgaatacatgtattgatcatctcgaacaattgattaacgtcaactttttctcttctgacaggacgtcattttgtgaatgcaatcgttttccataaattcttctcccctcataggcgacgaatagcattttgtgttgaggatcacaaaacgaataattgctgatcgccgcgataaggtcagacaaagacaacaagggaaattttcacagagcttttgatcggcgtaggccacagaatgttgcttcgtttactgtaacgccgggtaaatgagcgttttttgatagtgcgaaagaaccctgcgaggaaaataagcatctattattgtttgtcatgatgacaaggcaggcatcaatgaaaggcttcccaattgcgcatatttttcacccttcaatcccgccaatgcacgcagtggttaacaatcacaatagaaatattgattattggacggtaaaaagaaagtttgcagaaattgtctccaccaatgacgttaataaaatttacagtataagtaatgaactgcggagagtattatctgcaataactgcattgaatttctatcatggcgatgttccttctgtcatgatccgaatccaaccggaaaatatgagtccattcattatagatatttctacaggagaacatgatgattatatcatacaaacattagatgtaggcacttttgcaccttttggtgaacaatgtacttgctcagccgtcaataaaaaagagctggaatgtattaaggagacgatttctaagtattgtgcaaaattcacccgaaaagaagccatcttaaccccccttgtgcactttaataaaaccagcattacttcagattgttggcaaattctctttttttcacccgatcattttaataatgatttttattgattatttataaaggataaaataatgttccctgtttcatcaattggtaatgatattagtagtgatttagtccgtcgaaaaatgaatgaccttcctgaaagcccaacaggaaataacctcgaagcactagcaccaggtatagaaaaactaaaacagacctctattgaaatggtcactttacttaacacgttacaacctggtggaaaatgcattatcactggtgattttcaaaaagaattagcgtacttacaaaatgtaattctttataatgtctcgtctcttcgtctggattttttaggttataacgcccaaattattcaacgatcggacaatacttgtgaacttaccattaatgaaccgttaaaaaaccaggaaatatccacaggtaatatcaatattaattgcccattaaaagatatttacaatgaaatcaggaggttaaacgtaatttttagttgtgggactggagatatcgttgatctatcctctctggacttacgtaatgtcgatttagattattatgatttcacagataaacatatggctaatactattttaaatccttttaaattgaattcaacaaattttactaatgccaacatgtttcaggttaattttgttagttcaacacaaaacgccacaatctcctgggattatttactaaaaataacgcctgttttaataagcattagcgatatgtattctgaagaaaaaatcaagtttgtcgaaagttgtttaaatgagcctggagacattaccgaagaacaattaaaaattatgagatttgcaattataaaatctataccaagggcaactcttacagataaattagaaaatgaattaacaaaagaaatatataaaagctcatcgaaaatcatcaattgcttgaacagaattaaattaacagagatgaaagaattctcatcagaaaaaatatatgattacatcgatataatcattgaagattatgaaaataccaaagaaaatgcttatctggtcgtcccccaaattaattatactatggatttaaacatagaagactctagctcagaagagttactttcagataataccctcgagaaagacgaaaattctccggacaatggctttgaggtcggggaatataacacatatgaagcatataactcagagaagcaatattttaccagagaggactatacgtatgattacgaccttttaaatgcaatatagacttaataacttcttacaaagtctattattaataccgtagatatttattcatcttaccctgtgcaccaaaagcaaaaactcactgacgcgggtttgaaactgatggcaaccgcaaaaatgcctgatgcgctacgcttatcaggcctacgccatctctgcaatatattgaatttgcgtgcttttgtaggcaggataaggcgttcacgccgcatccggcatgaataaagcgcactcaacaatctgaaacccgccggaacggtttattacgtacatcaggtaaaactgaccgataagccgctttcttttgggtatagtgtcgtggacagtcattcatctttctgcccctccaaaagtaaaaacccgccgaagcgggtttttacgtaaaacaggtgaaactgaccgataagccgctttcttttgggtatagtgtcgtggacagtcattcatctttctgcccctccaaaagcaaaaacccgccgaagcgggtttttacgtaaaccaggtgaaactgaccgataagccgctttcttttgggtatagcgtcgtggacagtcattcatctttctgcccctccaaaagcaaaaacccgccgaagcgggtttttacgtaaatcaggtgaaactgaccgataagccgggttctgtcgtggacagtcattcatctaggccagcaatcgctcactggctcaagcagcctacccgggttcagtacgggccgtaccttatgaacccctatttggccttgctccgggtggagtttaccgtgccacggactgttaccagccgcgcggtgcgctcttaccgcaccctttcacccttacctgatcccgcttgcgcgggccatcggcggtttgctctctgttgcactggtcgtgggtttcccccccaggcgttacctggcaccctgccctatggagcccggactttcctcccctccgcccgtctcccccgaagaggacgacgacgaagcggcgactgtctggtcagcttcggcgcgcagtatagagggtttgcgcgcccttgtcaccccgcgttgcgcattccaatcgccagtgtcgcggcgatattacgtgaagcacggcagatattgtcataagccccgcggaatgcttcgtccaacgtacctatgctggtcaatacgctgaagaccgcatcaatgccatgctgatgtacaacgccaacatcatcggtcaggctacccgcaatgccaatcaccggtttatggtacttcttcgccacgtttgcgacaccaatcggtaccttcccgtgaatactctggctgtcaatacgcccttcaccggtgatcaccagcgtacaatcgtgaatatgttcctccagattcagcgccgtagtgacgatttcaataccacttttcagttccgcaccaagaaacgccattagcgccgcgcccataccacccgcagctcctgcaccggggacatctttcacatcaacatgcagcgcttttttaatgacctcggcatagtgagagaggttattgtccagctcaacaatcatcgcttcactggctcccttttgtgggccaaagatgcgcgatgcgccgttatcgcccaccagcggattggtgacatcacaagcgacgcgaatgacgcaatcttttaagcgcggatcgaggccggaaatatcaatatcattcagagtattaagactaccgccgccaaaaccaatttcattgccgttggcgtcgcataatttcgcccccagcgcctgtaccatgcctgcgccgccatcatttgtagcgctgccgccaatgccgataataatgtttgtcgcaccgctctccagcgcctgcaggattaactcgcctgtgccgcgtgaagtggtcacgagtggatcgcgtttttccgcaggtaccagctccagcccactggccgccgccatttcaataaacgcggttttgccatcgccggagatcccccaactggcattcactttctcgcccagcggccctgtaacccaggcgtgacgttcagccccctgggtggctgcaatcatcgcttccaccgttccttcgccaccgtcggcaaccggaacagaaacgtactgtgcatcaggaaaaatttcccgaaatcctttttctatcgcctgcgcaacctcgctggcagataaactttctttataagagtctggggcgattacgattttcatacctatgcctgttaccacatgacgccggagggcgtttctcttattcggcctggattccaggcccggattgcaatacgccatccgggcacgacgtcattaacgagtaacttcgactttcgccagtttttcgtagtagcacgccagggcgctatgatccgccgttcctaaaccatctgctcgcagtgcctgcatcatctccataaccgcagctgtgagcggcagttgtgcgccgacgccgtgagaagtatccagcgcattcgccagatccttaatatgcagatcaatacggaagcccggcttgaagttgcggtccatcaccatcggcgctttggcatccagcacggtactgcccgccagtccaccgcgaattgcctgataaaccaggtccgggttaacgcccgctttagttgccagcgttaacgcttctgacatcgcggcaatattcagcgccacaatgacctgatttgccagtttggtgacgttacctgcaccgatttccccggtatgcaccacggaacccgccatcgctttcatcaaatcatagtatttgtcgaaaatagccttgtcgccgcccaccatcactgacagcgtaccgtcgatggctttcggttcaccgccgctcaccggagcatccagcatatcaatgcctttcgctttcagcgcttcgctgatttcacggcttgccagcggtgcgatagaactcatatcgatcaataccgtacctggcttcgcgccttcaataatgccattctcacccagcgccacctctttcacatgaggggagtttggcagcatggttatgatgacgtcgcactgttcagcgatcgctttagccgtagacgctgtttctgcacctgcagcaatcacgtcagcaatagcttctgggttacggtcagcaaccaccagcgagtaacctgctttcagaaggtttttactcattggtttacccataatccccaggccaataaaaccaactttcatagtcatatcaatcatctctcttgttgcggtggtggttattttttaaaggtatcagccagtttctgagtggcagagcggaagacgccgagatcgctgccgacagccacaaacgtcgcgccccattccagataacgacgcgcatcggcttcgaccggcgcgaggataccgctgggtttgccgtgcgcgctggcacggttaaaaatgtgctgaattgctttttgtacatccgggtgtgatgcattgccgagatggcctaatgccgcggccagatcgctggggccgacgaagatgccgtctacgccttcggtagcggcaatggcatcgacgttatctacgccctgctgactttctatctggaccagaatagtgatgttcttgttcgactgagcgaaataatccgccacggtgccaaacatattggcgcggtgagaaacggagacgccgcgaatgccttccggtgggtaacgggttgatgccaccgccagctctgcttcctcttttgtttctacaaaaggaatcaggaagttatagaaaccgatatccagaagacgcttaataattaccggctcgttggtcggcactcgcactactggcgcgctggcgctgcctttcaaggccattaactgcggaataaacgtggagatatcgtttggcgcatgttcgccatccagcaccagccagtcaaacccagccaaaccaagaacttcagtgctaatcgggttagagagtgctgaccagcaaccaatttgtacctgtttcgcagccagtgcggctttgaatttattcgggaaaacatcgttattcatcgcttatacctttgcttatttctgcaattccatacgtttaatgtcgccaactacgaagaggtagcagaccatcgccatcagcgctgaacatcccacgaaaaccagtgctgcattgaaggagtgcagttcacttaccaggtagccaatcaccagtggagtgacaatggaggcaacattgccaaagacgttaaagacgccgccgcagaggccaacaatctctttcggcgcggtgtcagaaatcaccggccagcccagcgcaccaaatcctttgccaaagaaagccagcgccatcagcatgaccaccagcgtggtgttgttggtgtagttacataagatgatggtggaagccagcaacattcccagcacaatcggtagcttacgtgccagggtcagggataaaccgcgtttgatcagataatccgagaagacacctcccagcacgccgcccgcaaaaccacacagtgctggaatcgaggcgaccagacccactttcagaatcgacatgcctttttcctgcaccagataaatcgggaaccaggtgaggaagaaccaggtgatggtgttgataaaatattgtccgaaaaatacgcccagcatcatgcggttagagagcaattgcttgatgtaatgcagtttgggtccgcttgctgccgcactgcccggctttttgtggtccatatcgaccaccgcgccattttcagagataaacttcagctcttccgcagacatacgtgggtgatctgtcgggttatgaatcaacttgatccacagcgccgtcagcacaaaaccaatcacccccataacggtaaagacgtgctcccagccccaggcgaaagtcagccagccaagcagcggcgaaaagagcgccagcgagaaatattgcgccgagttaaagatggcggaggcagtaccacgttctttcgtcgggaaccaggcggcgacaattcgggcgttcgccgggaatgatggcgcttccgagaagccgagcataaagcgcataaagaacatggagatccctgcccaggccagcgggaacatatcaacaaagccttgcaggaaggtgaatagcgaccagaaaaagaggctgtaggtgtaaacttttttcgagccaaacttatcaagcagccagccgccggggatttgcatcagcaagtaggcccagccaaaagcggagaagatgtaacccatcgaaaccgcacttaactgcaactcttttgccacttcggtaccagcaatagacagcgttgcacgatcggcgtagttaacggcggtaacaataaaaataatcagtaatattaaatagcgggtatgcacgcctttctttttttcgtcaacggtgtccagaatcattttatttacctcgggtacttatgctgatttttattattatggggaaggtgttatttatgagtttcatttatgccgtaacgacaatgaactcgggaattagtataagcagcgcgagaataataatcattgtgcaaatgctaatttaattaatactatttaaatattattttgagcatatgcacataaggttgcgcgctaaagcacagatttgcgctttaccttaccgggcggcactgcaatccctgaaatgattgacattgatcacatttctgcgtttaaactcctgacattcttatttcacccaatgaagtcatttatttttaaatgagaccaggtcctcattttaataacccctggctggagaatattgcacaatggccaacatcgaaatcagacaagaaacgccaactgcgttttatataaaagttcacgacacagataatgtggcaattattgttaatgataatggcctgaaagcaggaacgcgttttccggatgggctggaattaattgaacatattccccaggggcataaagtcgcattgctggacattccggctaatggtgaaattattcgttatggcgaagtgattggttacgccgtgcgtgcaatcccacgcggaagctggatcgacgaatcaatggttgtactaccggaagcgccgccgttacacacgctgccactggcaaccaaagtcccggaacccttaccgccgctggaaggatacacctttgagggctatcgcaatgccgatggcagcgtgggcaccaaaaacctgctcggtatcaccaccagcgtccactgtgtggcaggcgtggtggactatgtagtaaaaatcattgaacgcgatctgctaccgaaatacccgaacgtcgatggcgtggtggggctgaatcatttgtacggttgtggcgtggcgattaacgcaccggcggcagttgtacctatccgtaccattcacaatatttcgctgaatcctaactttggcggcgaagtaatggtgattggcctgggttgtgaaaagttgcagcctgagcgcctgctgactggaacggatgatgtgcaagctattccagtagaaagcgccagcattgtcagtttgcaggatgaaaagcatgtcggttttcagtccatggtcgaggatattttgcagatcgccgaacgccatctacaaaaactgaatcaacggcagcgagaaacctgcccggcttcagaactggtcgttggtatgcagtgcggtggcagcgatgcgttttctggtgtaacggcaaacccggcggttggctatgcgtctgatctactggtgcgctgcggcgcaacggtgatgttttcagaagtaacggaagtgcgtgacgcgatccatctgctgacaccacgcgcagtgaacgaagaggtcggcaaacggctgctggaggagatggagtggtacgataactatctcaatatgggaaaaaccgaccgcagcgccaacccttcgccgggcaacaagaaaggcggtctggcaaacgtggtagagaaggcactcggctccattgctaaatcgggtaaaagcgcaattgttgaagtgctgtcgcccggtcaacgcccgactaaacgcggattaatttacgccgcgacgccagccagcgattttgtctgtggcacgcaacaggtggcttcgggtatcacagtgcaagtgtttacgaccggtcgtggtacgccgtacggcctgatggcggtacccgtcattaaaatggcaacccgcaccgagctggcgaaccgctggtttgatttaatggatattaatgcgggcaccatcgctaccggcgaagaaactattgaagaggtgggctggaagttgttccactttattctcgacgtcgccagcgggaagaagaaaaccttctcggatcaatgggggctgcataaccagctggcggtgtttaacccggcaccggtgacctgatttcttttggaacgtccctcgcaaaacatggccttagtgccatgtttttattgtttaaagcccccacgtccattaataatgcatttgcattaccttagttcaagcttataatttgagcagaaaacaggctgtaaaaggacagtgaatcatgcccgctaatgctcgctctcacgctgtactgaccactgaatcaaaggtcacgatacgcggacaaacaactatccccgcgccagtgcgtgaggccttaaaactgaagccaggccaggacagcattcattacgaaattctgcctggtgggcaagtatttatgtgccgactgggagatgaacaggaggatcatactatgaatgcatttttgcgttttctggatgcagatatccagaacaacccgcaaaaaactcgtccattcaacattcaacaaggaaagaaacttgtcgctggcatggacgtcaacattgatgatgagattggcgacgacgaataatggattttccacaaagggttaatggttgggcgctatatgctcatccctgttttcaggaaacctacgacgctttagttgccgaagtcgagacattaaagggaaaagatcctgaaaattatcagagaaaagccgccacaaagttattggcggtagtccataaagtgattgaggagcatatcacggtcaatccatcatcaccggcattccgtcatggcaagtcgttaggctctgggaaaaataaagactggtcacgggtaaaatttggtgctggtcgttatcgtctcttctttcgttatagtgaaaaagagaaagtcatcattctgggatggatgaacgatgaaaacactctgcgcacctacggtaaaaaaacagatgcctataccgtattcagcaaaatgttaaaaagaggacatcctcctgccgactgggaaaccctcacccgagaaacagaagaaacccattgatggtgttcacaatgcccgccgaacgcattcgtgttgaccagcgggcatcctttctcactccccgaccagaatcacttcaaccccagcctttcgcagtccttccaggctatccgcaggaatgccttcatcaacaatgatcatgtcgatacgttgagtatcaatgatcttatgtaaactggaacgattgaacttactggaatcggtgaccacgatgatccgttccgcaacttcgcacatccgacggtttaaacgagcttcatcttcattatgtgtgctgacgccgcgctccagatcgatcgcatctacaccaagaaacagcatatcgaagtggtaattttgcagcgattgctcagcctgatcgccgtaaaaagattgcgactgacggcgcaaatgcccgccggtcatcagcagctcaacgccttccgcttccagcaacgcattagccacgttcataccgttggtcatcgcaattacgtcagtgtgcttgcgcatcagacgagcaatctcaaaagtggtggtcccggaatcgaggataacccgatgacctggctgaatcaactcaacggcagctttcgcaacgctgcgtttcatcgcggtgttcagtgcgcttttatcttccactgatggctcgactgacggcgtcgtgctatcgcagatcaacgcgccaccataggcacgcacagcgatcccctgcttttccagaaacgccagatcgttgcggatcgtcacagtagatacgccatacaatgccgacagatcgttaacctgcacactcccttgctgtcgcagacgctgaatgatctgttctcgtcgctcgctggtgccagtcactcgcttctcacctgaagcgtcggtattactcatagtaagtcctttcgtaaaactttcgtttcatttcgttttgcctattaacgcctttctattaagcaaatgcaagcccaccttgcccattgacgcaagctactctcgtttcagtgactttcattatgtttcttttgtgaatcagatcagaaaaccattatctttcgttttatttttatctcaccatgacgcagtatcaactgaaacaaaacgaaagattaatatcgcagtaatctgaactggagaggaaagtgaaacatctgacagaaatggtgagacagcacaaagcgggcaaaacaaatggaatttatgccgtttgttccgcacatccgctggtgctggaagctgcaatccgctacgccagtgcaaaccaaacgccgttactgattgaagcaacctccaatcaggtagaccagttcggcggttataccggaatgacgcccgccgattttcgcggctttgtttgtcagctcgccgactcgttgaatttcccgcaggatgcgttgattctgggtggtgaccatctggggccaaaccgctggcaaaacctgccggccgctcaggcaatggccaatgccgatgatttgattaaaagctacgttgcggcaggattcaaaaaaatccaccttgattgcagcatgtcctgtcaggacgatccgattcccttaactgatgacatcgtggctgaacgcgccgcccgtctggcgaaagtggcggaagaaacctgtcttgaacactttggcgaagccgatctggagtatgtcattggtaccgaagtgccggtacctggcggcgcgcatgaaaccttaagcgagctggcggtcaccacgccggatgccgcccgcgccacgctggaagcccatcgtcacgcctttgaaaagcaaggtttgaatgccatctggccacgcatcattgccctggtggttcaacccggcgtcgaattcgatcacaccaacgttattgattatcagcccgccaaagcgagcgccttaagccagatggtcgaaaactacgaaacgctgattttcgaagcgcactctaccgattatcaaacgccgcaatcgctgcgccagctggtgattgaccactttgccattctgaaagttggcccagcgctgaccttcgccctgcgtgaagctctgttctctctggcggcgattgaagaagaactggtgccagcgaaagcctgttctggtctgcgtcaggtgctggaagacgtgatgctcgaccgcccggaatactggcaaagccactaccacggtgacggcaacgcgcgtcgtctggcgcgtggttatagctactcggatcgcgtgcgctattactggccggacagccagattgatgacgctttcgctcatctggtacgtaatctggcggattcaccaattccgctgccgctgatcagccagtatctgccgctgcagtacgtgaaagttcgctccggcgagctgcagccaacgccacgggaactcattatcaaccatattcaggacatcctggcgcagtaccacacagcctgtgaaggccaataagcaaaacaaagaggaacacgctatgccaaatattgttttaagccggattgatgaacgcttgattcacggtcaggtcggcgttcaatgggtcggatttgcgggggcaaatctggtgctggtagccaacgatgaggttgccgaagatccggtacaacaaaacctgatggaaatggtactggcagaagggatcgccgtacgtttctggacgctgcaaaaagttatcgacaacattcatcgcgccgccgatcgacagaaaatcctgctggtttgtaaaacacccgccgatttcctgacgctggtgaaaggtggcgttccggtgaatcgcattaacgttggcaatatgcactacgccaatggcaaacaacaaatcgccaaaacggtttctgtggatgcgggcgatatcgcagcatttaacgacctgaaaaccgctggggtggaatgcttcgttcagggcgtcccgacagagcctgctgtggacctctttaaattactttgagggattcatcatggaaatcagcctgttgcaggcatttgcgttgggcattatcgcctttatcgctggcctggatatgtttaacggcctaacccatatgcaccgcccggtggtcctcggcccgttggtcgggctggtacttggcgatctgcataccggaattttaaccggcggtacgctggaactggtgtggatggggctggccccgctggcgggcgcacagccgcctaacgtgattatcggtactatcgtcggcacggcgtttgccattactactggcgtgaaacccgatgtcgcagtaggtgtcgccgtacctttcgctgtcgcagtacagatggggattaccttcctgttctcggtgatgtccggcgtgatgtctcgctgcgacctggcaacaaacccgcgccgcatttgatgctggtgccgacggcctggtgcattgctataacgggatgacaggtttacatcaccgcgaaccgggaatggttggcgcgggattaacggacaagcgcgcctggctggaactgatagccgatggtcatcatgtgcatccggcggcaatgtcgctgtgttgttgctgtgcgaaagagagaatcgtactgatcaccgacgcgatgcaggcagctgggatgccggatggtcgctatacgttatgtggtgaagaagtgcagatgcacggtggcgttgtccgtaccgcgtctggtgggctggcgggcagtacgctgtctgttgatgcggcagtgcgcaatatggtcgagttgacgggcgtaacgcctgcggaagccatccatatggcgtcgctgcatccggcgcgaatgctgggtgttgatggtgttctgggatcgcttaaaccgggcaaacgcgccagcgtcgttgcgctggatagcgggctacatgtgcaacaaatctggattcagggtcaattagcttcgttttgatagtttgctcctttattgggccttcacttcccccgtaaggcctttctttttctttcgttttgatctgtgcagcggtgtcggatgcgacgctaacgcgtcttatccgacctacagttggtgaccgcaaggccggataaagcgtttgcgccgcatccagcaatcccttttgcttcctttatcttttctttcaacgatcacaaatttcgttttatttcttttttctccattgaactttcagtttcttttctatagattttaatcaacgaaagacatcaccaagtgaaatgaaacgaaaggcaagtgaaagcgacaacgcccgacgtcaagttcatcagactaaggattgagttatgccagaaaattacacccctgctgccgccgcaaccggtacatggactgaagaagagatccgccatcagcctcgcgcatggatccgttcactcaccaacatcgacgcgctacgttccgcgctcaataacttccttgaaccgttactgcgcaaagagaatctgcggatcatcctgaccggagccggaacgtcggcatttatcggtgacatcatcgcgccgtggctcgccagccataccggtaaaaacttcagcgccgtaccgaccaccgatctggtcaccaatccgatggactacctgaacccagctcatccgctgctgttgatctccttcggtcgatccggcaacagcccggaaagcgtcgcagccgtggaactggcaaatcaatttgtaccggaatgctatcacctgccgatcacctgcaacgaagcgggcgctctttaccaaaacgcgatcaacagcgataacgcgtttgccctgctgatgcccgcagaaacgcacgatcgcggctttgcgatgaccagcagcattaccaccatgatggccagctgcctcgcggttttcgcacctgagacgatcaacagccaaaccttccgcgacgtggcggatcgttgccaggcgatcctgacctcactgggcgatttcagcgaaggtgtgtttggttacgcaccgtggaaacggatcgtttatctcggtagcggtggcttacagggcgcagcacgcgagtcggcgctgaaagtgctggaactgacggcgggtaaactggcggccttttatgattctccaaccggattccgtcatggaccaaaatcgctggtcgatgacgaaacgctggtggtggtatttgtctccagccacccttacacccgtcagtatgatcttgatctgctggctgaacttcgccgtgacaaccaggcaatgcgtgtaatcgccatcgccgcggaaagcagcgacatcgtcgctgccggtccacatatcatcctgccaccgtcacgtcactttatcgacgttgagcaggcattttgcttcctgatgtacgcccagacgtttgcactgatgcagtcgctgcacatgggcaatacgccggataccccatcagccagtggcaccgttaaccgcgtggtgcaaggcgtaatcattcatccgtggcaggcataagaggatcgcattatgagcattatctccactaaatatctgttacaggacgcccaggccaatggctacgcggtgcctgcttttaacattcataacgccgagacgatccaagcgatcctcgaagtgtgcagtgaaatgcgatcgccggtgatcctcgccggaacgccggggacctttaaacacatcgcgctggaagagatctacgccctgtgtagcgcctattccacaacctacaacatgccactggcgctgcatctcgaccaccacgaatcgctggatgatattcgccgtaaagtccacgcaggtgtgcgcagtgcgatgatcgacggcagccacttcccgtttgccgagaacgtgaagctggtgaaatcggttgttgacttctgccactcacaagattgcagcgtggaagcagaactgggccgcctgggcggtgttgaagatgacatgagcgttgacgccgaaagtgcattcctgaccgatccacaagaagctaaacgctttgtcgaactgactggcgtcgacagcctggcggtagcgattggtacggcgcacggcttatacagcaaaacgccgaagattgatttccagcggctggcggaaattcgtgaagtggtggatgttcctctggtgctgcatggtgccagcgatgttccggatgaatttgtccgtcgcactattgaacttggcgtcacaaaagtgaacgttgccacagaattaaaaatagccttcgctggcgcggttaaagcctggtttgcggaaaatccgcagggtaatgatcctcgttattatatgcgcgtcggaatggatgcgatgaaagaagttgtcagaaataaaattaatgtctgtggttcagcgaatcgaatttcagcataatcattagttttttatgatttatcccaatgtacttcccgattaatatcggggagtgccttaatggaaaaggagataactaaaccttaataaatacatcactacaatatcgcaacaataatatatttaaaaaaattatattattcaactttatggtgaggattacacaatgaccagtccaaatattctcttaacccgtattgataaccgtctggttcacggtcaggttggcgtgacctggacatccaccatcggtgcaaatctgctggtagtcgtggatgatgttgtcgctaacgatgatattcaacagaaattaatgggtattaccgcggaaacctacggctttggcattcgtttctttactatcgaaaaaaccattaacgtcatcggcaaagctgcaccacatcagaagatcttcctgatttgccgtacgccacaaacggtacgtaaattggtagaaggtggtattgacctgaaagatgtcaacgtcggcaatatgcatttctcggaagggaaaaagcaaatcagcagtaaagtttatgtcgatgaccaggatctcacggacttacgttttattaaacaacgtggcgtgaatgttttcattcaggacgtccctggcgatcaaaaagaacaaatccctgactaaatctaaaatcgccttaatattggtttgaggtaataaaaatgcatgaaataaccctacttcagggattatccctggcggcgttagtttttgttctggggattgatttttggctggaagccttatttttattccgcccgataatcgtttgtaccctaactggcgctattctcggtgatattcagactggcttaattaccggtggtctgacagagttggctttcgccggattaacccctgcaggtggtgttcagccgcccaacccgattatggcgggtctgatgaccaccgtcattgcatggtctacgggcgttgatgccaaaacagcaattggtcttggcctgccgtttagtttgttaatgcagtacgtcattctgttcttctattccgctttctcattatttatgaccaaagccgataaatgcgcgaaagaggcggatacggcagcgttttcccggcttaactggacaacgatgctcatcgtcgcttcagcgtatgcggtgattgctttcctctgtacttacctggcacagggggcgatgcaggcgctggtgaaagcgatgcccgcctggctgacccacggctttgaagtggctggcggtattctgcctgccgttggttttggcttgctgctgcgcgtaatgttcaaagcgcaatatatcccttacctgatcgccggtttcctgtttgtttgctacatccaggtcagcaacctgttgccggttgccgtactgggcgcaggctttgcggtgtatgagtttttcaatgcgaaatcccggcagcaagcgcaaccgcagcccgttgccagtaaaaatgaagaagaggactacagcaatgggatctgaaatcagtaaaaaagatatcacccgtctgggctttcgttcgtcgctgctgcaagcgagctttaactacgaaaggatgcaggcgggcggttttacctgggcgatgttgccgatcctgaaaaagatttataaggacgacaaaccgggcttaagcgcggcgatgaaagataacctcgaatttattaatacccacccgaatctggtcggattcctgatggggttattaatttcgatggaagaaaaaggagaaaaccgcgacaccattaaaggcctcaaagtggcactgtttggcccaatcgccgggattggcgatgcgattttctggtttactttgttgccgattatggcgggaatttgctcatcatttgccagccagggaaacctgctggggccgattctatttttcgccgtttacctgcttatctttttcctgcgcgtcggctggacccacgtcggttattcagtcggcgtgaaggcgatcgataaagtgcgagagaactcgcagatgattgcccgttcggcaaccatcctcgggatcacggtaatcggcgggctgatcgcttcgtatgtgcatattaacgtggtgacatcgtttgccatcgacaatacccacagcgttgcgctgcagcaggatttcttcgataaagtcttcccgaacattttaccgatggcctacaccctgctgatgtattacttcctgcgggtgaaaaaagcgcatccggtgctgttaatcggcgtgacttttgtgctctctattgtttgttccgcattcggcattttgtaaatggaacgaggcactgcgtctggtggtgcctctttacttaaggaatttcatcctgtgcaaacccttcagcaagttgaaaactatacggcgttaagtgaacgtgccagcgaatatttattggccgtgatccgtagcaaaccgaatgccgtgatttgcctggcgaccggagccacgccattactgacgtatcattatctggtagaaaaaatccaccagcagcaggttgatgtcagccagctcaccttcgtgaagctcgacgaatgggtggatctgccattaacgatgccaggcacctgcgaaactttcctgcaacagcatatcgtgcagccgctggggctacgtgaagaccagctcatcagctttcgctccgaagagataaatgagacagagtgcgaacgggtaacgaacctgattgcgcgcaaaggcggtctggatttatgcgttctcggattggggaaaaacggtcatcttgggctgaacgaaccgggagaaagcctgcaaccggcctgccatatcagtcaacttgatgccagaacacagcaacatgagatgttaaaaaccgcgggtcgccccgtgactcgtgggatcaccttaggcctgaaggatattctcaatgcccgcgaagttttgttactggtgactggcgaaggaaagcaggatgcgacagatcgttttctcacggctaaagtctctaccgctatcccggcttcatttttatggctgcacagtaactttatttgtttaattaacacctaaccagatgaaaaatttgctcaaaatgtttaaattaacttatgtaacagtcacgcattatattaaataacatttgactgggttgaacataacgccgatagcaaaaggagttatgttcaacaatttaattttagatatacatataacttgttctattaataaatcacctcgtattctgactcgccccctggcgcagcaaagtcaggcatttatactcttttgaatacatagaaaattgatatcaatataatgaaaatatcaaatatttgcatataaatataatcttaaagttcagtctatttaatgttcaatgaaatatttctgcctgtataatctttaaagatgttgaacatatattcacattaaatatgattatgtacttgttacaaggataaggttatatatgaataaagttacaaaaacagctattgcgggcttacttgcgcttttcgcaggtaatgccgctgcaaccgatggtgaaatagtttttgatggcgagattttaaaatccgcttgtgaaatcaatgactctgataagaaaattgaagttgctcttggtcactataatgccgaacagtttcgtaatattggcgagcgtagcccaaaaattccattcactattcctttagttaactgcccaatgactgggtgggagcacgataacggcaacgttgaagcgtctttccgtctatggctggaaacgcgagataatggcaccgtccctaacttccctaatctggcaaaagtaggctcttttgctggcatagcggcaacaggtgtgggtatccgtattgacgatgcggaaagcggaaacattatgccactgaatgctatgggcaatgataacacggtttatcagatcccggcggaatccaatggtattgtcaatgttgacctcatcgcttactacgtatcaaccgtagttccatcagaaatcaccccaggggaagcagacgctatcgttaacgtaacgctggattaccgttaatacgttagggcgttatctgacctgtcagataacgcccttttccttcctctttctcgttgtatcaggttgaaaaataactatgtcaaaacgaacattcgcggtgatattaaccttgttgtgtagcttctgtattggccaggcgcttgcaggaggaatcgttttacagcgaacgcgagtgatctatgatgccagccgcaaagaggctgcgttacctgtcgcaaacaaaggcgcagaaacgccttatttactgcaatcatgggtagataatatagatggtaaaagccgtgccccatttattataaccccaccgctatttcgtcttgaggctggcgatgactcatcactgcgaattattaaaacagctgataacctgcctgaaaataaagagtcgctgttctacattaatgttcgtgccattccagcaaagaaaaaatcagatgatgttaatgctaacgagttgacgctggtatttaaaacacggatcaaaatgttttatcgccccgcacacctgaagggacgggtaaacgatgcgtggaaatcactggaatttaaacgtagtgaccattcactcaatatatataacccaactgaatattacgtcgtatttgccggactggcagtcgataaaaccgatctcacaagcaaaattgaatatatcgcgcccggagaacataaacagttaccacttcctgcatctggcggaaagaacgtgaaatgggctgcgatcaatgattatggcggcagttccgggacagaaactcgtccactgcaataaaaaatataaaaacacaggtcatcagggaatgccacaacgacaccaccagggacataaacgcacaccgaaacagttggcgctcatcatcaaacgttgtttgccgatggtgctcactggcagcggcatgctttgcactaccgctaacgccgaagagtattatttcgaccccattatgctggaaaccacaaaaagtggtatgcaaacaaccgatctgtcgcgtttttcaaaaaaatatgcacaactaccaggaacttatcaggttgatatctggctgaataaaaagaaggtttcacagaaaaaaattacatttaccgccaatgcagagcaacttctgcagccacagtttacggtagaacaactacgtgagctgggtattaaggtggatgaaatcccggcgctggctgaaaaagatgacgatagcgtgatcaactcgcttgaacaaatcattcccggtacagctgctgaatttgatttcaatcatcagcaacttaatttgagcattccccaaattgcactgtaccgtgatgcaagaggttacgtctccccttctcgttgggacgatggtataccaacgctgtttaccaactactcgtttacaggttctgataaccgttaccgccagggcaatcgtagccaacgacagtacctgaatatgcaaaatggtgctaattttggcccctggcgattacgcaactattccacatggacacgcaacgatcagacatcaagctggaataccatcagtagttatttacaacgtgatatcaaggcgttgaagtctcagttgcttctgggagaaagcgccaccagcggcagtattttttccagctacacctttactggcgtgcaactcgcttccgacgataatatgttgccaaacagccagcgcggatttgccccaacggtacgcggtatcgcaaacagtagtgcaatcgtgactatcaggcaaaatggttatgtgatctatcaaagcaacgtgtcagcgggtgcctttgaaattaacgatctctacccctcttccaacagcggcgatttagaagtcacgattgaagaaagtgacggtacacaacgtcgctttatccagccttattcttcattacccatgatgcagcgacctgggcatctaaagtatagcgcgaccgctggacgctatcgcgctgatgcaaacagtgatagcaaggaacccgaatttgctgaagccacggcaatatatggtttgaataatacttttacgctgtatggcggcctgctcggttctgaagattattatgcgctggggatcggtatcggcggcacacttggcgcactgggcgcgttgtcgatggatatcaacagagctgacacccaattcgataaccagcactcttttcatggctatcaatggcgtacgcagtacatcaaagatatcccggaaaccaacaccaatatcgctgtcagctactatcgctataccaacgatggctattttagttttaatgaagccaatacccgcaattgggactataacagtcgccaaaaaagtgaaattcaattcaacatcagccagacaatatttgatggggtaagtctgtatgcctccggttcgcagcaagactattggggcaataacgataaaaacaggaatatctctgttggggtttccggccagcaatggggagttggttacagcctgaattatcaatacagccgctacactgatcaaaataatgaccgcgcactctctttgaatctcagtattccgttagaacgctggttaccgcgtagccgggtttcctatcagatgaccagccagaaagatcgcccaacccaacatgaaatgcgtcttgatggctcactgctggatgatggtcgcctgagctatagcctggaacaaagtctggatgacgataacaaccataacagtagcctgaacgccagttaccgttcaccttatggcaccttcagtgccggatacagctacggtaatgacagcagccaatacaattacggcgttaccggcggcgtggttatccatcctcatggcgtgacgctctcgcaatatctgggcaacgcttttgcgcttatcgatgctaacggagcatctggcgtgaggatacaaaactatccggggattgctaccgatccttttggctatgcagtggttccttatctcacaacttatcaggaaaaccgtctctcggtagatactacgcagctgcccgataacgtcgatcttgaacaaacaacacagtttgtggtgcccaacagaggtgcaatggtagcggcgcgtttcaacgccaatatcggttatcgcgtacttgttacagtcagcgatcgcaacggtaaaccgttgccctttggcgctcttgccagcaacgatgatacggggcaacaaagtatcgtcgatgagggcggcatactatatctctctgggatatcgagtaaatcacaaagctggactgtacgctggggaaatcaggcagatcaacaatgtcagtttgctttcagtacaccggattcagaacctacaacctctgtattacaaggcacagcgcagtgccattaaggataaaaaaatgaaaagagcgcctcttataacaggtcttttgttgatatccacatcctgcgcttatgcctcctcaggagggtgtggagccgacagcactagcggtgcgacaaattacagcagtgtggttgatgatgttacggtgaaccagacagataacgtgacaggacgggagtttacctctgcaacgctaagtagcactaactggcaatacgcctgttcctgctctgcgggtaaggcagttaaacttgtctatatggtcagccccgtacttaccaccactggacatcagacaggatattacaaactcaatgacagcctggatattaaaaccacattacaggcaaacgacattccaggactcacaaccgaccaggttgtctctgttaacacccgattcacacagataaaaaacaacacggtatattctgctgcaacccaaacgggtgtttgccagggtgatacgtctcgttatggacccgttaatattggtgcgaacaccacctttaccctgtatgtcaccaagccatttctcggctcgatgaccattccgaaaacggatattgccgtcattaaaggcgcgtgggtcgatggaatgggaagcccgtctacaggtgacttccatgatttagtcaagttatcgattcagggaaatctcaccgccccacagtcgtgcaaaattaatcagggcgatgttattaaggttaattttggattcatcaatggtcagaagtttaccacccgcaatgccatgccagacggttttactccagtagactttgatatcacttatgactgtggtgatacttcaaagattaaaaactcgttgcaaatgcgcatcgacggtacaactggggtagtagaccagtacaacctggtcgccaggcgaagaagttcagacaatgtgcccgatgtcggtattcgtattgaaaatctcggcggcggagttgcaaatattccttttcagaacggtatccttcccgttgatccttccgggcatggcaccgtcaatatgcgcgcctggccagttaatctggtcggtggtgagctggaaacaggaaaatttcagggcacagccaccattaccgtcatcgtgcggtaaaagaagacgttgcgttttgattaacgcaacgcttcggcactgttacccctgctgctccagcgcatacttatacagcgcatttttcttcacgccgtgaatttctgcggccagcgccgccgcttttttcagcggcagttctgcctgtagcagcgccagcgtgcgcagggcatcggcgggtaagtcttcttcctgtgctttatgaccttcgacaatcagcaccatttcgcctttgcgacggttttcatcttcctttacccacgccagcagctcgccaacgggcgcgccgtgaatggtttcccaggttttggtcagctcacgcgccagaaccacgtagcgggattcgcctaataccgcaacgatatcttccaggctatctaacagacggtgggtagattcataaaaaatcagcgtgcgcggctccgcttcaatggcttttagcgcatcacggcggccttttgatttggcaggtaaaaagccttcgtaacagaaacggtcagagggtaaacccgctgcgcttaacgcagtgatagcagcacacggcccgggtagcggcaccacgcggatccccgcttcacggcaggtacgcaccagatggtagccaggatcgttaattagcggcgttccggcatcggaaaccagcgcaatgttttgcccctcttgcagcttcgccagcagcgtttcagctttttgttgttcgttatggtcgtgcagcgcaaacaaccgggcattaatcccaaaatgttgcagcaataaaccggtgtgacgagtatcctcggcggcaatcagatcaacggcctgtaatacctctaacgcacgctgggtgatatccgccagattgccgattggcgtcggtacaatgtaaagctggccctgagaattatccgccgattggtgttgtttcattgtgtcgtccgtattgccgatttaatattgagcattgcgtaaaaaaaatatcactggatacattatggtaccctcaacattttctcgtttgaaagccgcgcgttgtctgcctgttgttctggcagccctgattttcgccggttgtggcacccatactcccgatcagtccactgcttatatgcagggcacggcgcaggctgattctgccttttatcttcagcagatgcagcaaagctctgatgataccaggatcaactggcaattactcgccattcgtgcactggtgaaagaaggtaaaaccgggcaggcggttgagttgtttaaccaactaccgcaagaactgaacgatgctcagcgtcgcgagaaaacactgctggcggtagagattaaactggcgcagaaagattttgctggcgcgcaaaacttgctggcgaaaatcacacctgccgatttagaacaaaaccagcaagcgcgttactggcaggcaaaaatcgatgccagccaggggcgtccttccattgatttactgcgcgcgttaattgctcaggaaccgctgcttggcgcgaaagaaaaacagcagaatattgatgccacctggcaggcgctctcctccatgactcaggaacaggcgaatacgctggtgatcaacgccgacgaaaatattctgcaaggctggctggatctgcagcgcgtctggtttgataaccgtaacgatcccgacatgatgaaagccgggatcgccgactggcagaaacgttatccgaacaatccgggcgcgaaaatgctgccaacgcagttggttaacgtaaaagcgtttaaaccagcctcgaccaacaaaatcgccctgctgttgccactgaatggccaggcagcggtatttggtcgcactattcagcaaggctttgaagcggcgaaaaatatcggcactcagccagtggcagctcaggtagctgccgcacctgccgcagacgtagctgaacaacctcagccgcaaaccgtggatggcgttgccagcccggcacaagcctcggttagcgatctgaccggtgaacagcctgcagcccagccggtgcctgtaagcgccccggcgacaagcaccgcagcggtaagcgcacccgcaaatccatccgcagagctgaaaatctacgatacctcatcacaaccacttagccagatcttaagccaggttcagcaggatggcgcgagtattgtggtcggtccgttgctgaaaaataacgttgaagagttgctgaagagcaacactccgctgaacgtactggcactgaaccagccggagaatatcgaaaatcgcgtcaatatttgttacttcgcgctttcaccggaagacgaagcgcgcgatgcagcgcgtcatattcgtgaccagggtaaacaagcgccgctggtgctgatcccacgcagttcattgggcgatcgcgtagccaatgcgtttgcgcaagagtggcagaaactgggcggcggcaccgttctgcaacaaaaatttggttccaccagcgaattacgcgcgggtgttaacggcggttctggtattgctttaacgggtagcccgattactctcagagcgacaaccgactccggcatgacgaccaacaatccaacgctgcaaaccacgccaaccgatgaccagttcaccaataatggcggtcgtgtcgatgcggtgtacattgtggcaacgccgggtgaaatcgcttttatcaaaccgatgatcgccatgcgtaacggtagccagagcggtgcaacgctgtacgccagctcccgcagtgcgcaagggaccgctggcccggatttccgactggagatggaaggcttgcagtacagcgaaatcccgatgctggcaggcggtaatctaccgttaatgcagcaggcactcagcgcggtgaataacgattattcactggctcgcatgtatgcgatgggcgtcgatgcctggtcgctggcaaatcatttctcacaaatgcgccaggttcagggttttgaaatcaacggtaataccggaagcctgacggctaacccggattgcgtgattaacaggaacttatcatggctacagtaccaacaaggtcaggtagtccccgtcagttaaccaccaaacagaccggcgatgcgtgggaagcacaagcgcgtcgctggctggaaggcaaaggactgcggtttatcgccgctaacgtgaacgagcgtggcggcgagatcgatctgataatgcgtgaaggccggaccaccatttttgtcgaggtacgctatcgccgctctgcgctttatggcggcgcggcagccagtgtgacccgcagcaaacaacacaaattattacagactgcccgcttgtggctcgcgcgtcataatgggagttttgatactgtggattgccggttcgatgtggtagccttcaccgggaatgaggttgagtggattaaggatgcctttaatgaccactcataattaaggtttaaggattagcgtgcaagaaagaattaaagcttgcttcactgaaagcattcaaactcaaattgcggcggcagaggcgcttccggatgccatctcccgtgcagccatgacgctggttcagtctctgctcaatggcaacaaaatcctctgttgtggtaatggaacttccgctgccaatgcacagcattttgctgccagcatgatcaaccgtttcgaaacggagcggcccagcttacctgccattgcactaaatactgataatgttgtcttaacggcgattgccaacgatcgcttacatgatgaagtgtatgcaaaacaggtgcgggcgctgggtcatgcgggagatgtattgttagccatttccacccgtggcaacagccgcgatattgttaaagcagttgaagccgccgttacgcgtgatatgaccattgtggcattgaccggctatgacggcggcgaacttgcaggtttgttagggccacaggatgtggagatccgcattccttcgcatcgtagtgctcgcattcaggaaatgcatatgctgacggtaaattgcctgtgcgatctgatcgataacacgcttttccctcaccaggatgattaaggagaatacatgaaggcattatcgccaatcgcagtccttatttccgcgctgctgttgcaaggttgtgttgccgctgccgtagtgggtaccgctgctgtgggtaccaaagccgcaactgacccacgcagtgtcggcacccaggtggacgatggtaccctggaagtgcgcgtgaacagcgcattgtcgaaagacgaacagattaagaaagaagcgcgcattaatgtaacggcctatcagggcaaagtgctgctggttgggcagtcaccaaatgctgaactttcggctcgcgccaaacagattgctatgggcgtagacggtgccaacgaagtgtataacgagattcgtcagggccagccgattggtctgggcgaagcatctaacgatacgtggatcaccaccaaagtgcgttcgcagctcttaaccagcgacctggtgaaatcgtccaacgtgaaagtgaccaccgaaaacggtgaagtgttcctgatggggctggtgactgaacgtgaagcgaaagcggcggcagatattgccagccgggtgagcggcgtgaagcgggtaactacggcgtttacgtttattaaatagcagccccttgtaatgcctgatgcgacgcttgccgcgtcttatcaggcctacaacgatacaaaccgtaggtcagataaggcgtttacgccgcatccgacatgttttccctcaaatcagaacaacagcgccagcccgccgacaatcacaccagacactgccaccatcgcccctgtcagccataaggctttcgccgggaacgctttgcgcagcataatcagtgacggcaaactcactgccgggagcgtcatcaacaatgccagcgccggagcggttcccatacctgccagcatcatcgtttgtacaatcggaatttctgctgccgtgggaatgacaaacaagcatcctgctaccgccatcgccaccacccacatcaggctgttatcgacagcaccatcggcatgggggaataaccagacgcgagcggcacccaacaccagtactgcaaggatgtaaaccgggatcgtactccagaaaagcgtccatagcgccctgccccagcggctaaaaaacccgccctgtgcttccggtatgtcaatttcgaccggtgcctgcgtttgcggtgtttcacgcacccatttttgcaccagcgtcgcaatcagcaacaccatcaccagcccggccaccagacgaatcgccgcaaaaccccagccgaggacaaagcccataaacaccagcgtcgccgggtttaacaccggattgcccatccagaatgccagcgcaccgcccatcgacacctgttggcgacgcattcccgccgcgaccggagccgcacagcaggtacacatcatgcccggcaacgaaaacagcgttcccagcagcgtgccgcgaaagcgcgattgcccaagcgtacgcaacaaccagtcacgcgggatcagcacctgaatcaacgaaccgaggatcacccccagcaccgccgctttccataccgcgaggaaatagatcatcgcgtaatccaacgccgcctgccatgggttagcatccgcctgcgcaaggatagatttaccgatactgtgggtttcggcagcagtaaacgctttgccgtagtaaggttcccatttcacataccagagaccggcaatgacaacgagaaagaaaagcgcgggtttccaccactgaatgggcgttgccgcctgagatgaagactgaccagtcatagcattccccaggaataagttatgataattgagcgcgtgaatattacgctcactatcaattcttgggaataattattcagctcttttgcgtaattctgaagagcttaaaatcgtcacgccttcatgctcaggccgcatcgactctgccagcatgacccgcgccacgtctctcgcatcaatggatttccagttacctggtaacaaacggaacagcggcgcaaaaagcgtttcgttcatccgctgtttgctacgatcgcccagtaacatcgacgggcgagcaatggtcaatttcggccagttctgggcgattaatgcttcttccatctcccctttgacgcggttatagaaaaacggcgagtgggcattggcacccatcgcactgactaccaacatatgctgcgcgcccagtcgccgcccggttaatgcggtatccactaccagcgtgtaatcggcatgaataaacgcctctttgctccccgcttctcgccgcgtggtgccgagacaacaaaacacaatgtcgatgggatcggtgacctgcgccaacgcgtcactcagttgcggatcatggggattaaacaccccgggcatatcgcccaacggacgtcgcgtcggcgcagcaatggcgttaactttcggttcgttaatcaacatccgcagcaggtgaccgcccaccagccccgttgcgcctgtaatcagtacctgactcatcttcgctcctttacagaattgtctgccttgcgctccacggctcatgcaccaggcttaatagaccatgaggtaattatccccgattgtgggaaattcgcctcatccaatgcaacaacgcggaggaagcatgagtaagaaaattgccgttttaatcactgatgaatttgaggattcagaatttacttcacccgcagacgagttccgtaaagccggacacgaagtgattaccattgaaaaacaagcgggtaaaacggtgaaaggcaaaaaaggagaagccagcgtgaccatcgataaatccatcgatgaagtgacgcctgcggagtttgatgccctgctgctaccgggcggccattcaccggattatctgcgtggggacaaccgttttgtcacctttacccgtgattttgtgaatagtggcaaaccggtgtttgccatctgtcacggcccgcagttgctgatcagcgccgatgtgattcgggggcgcaaactgaccgcagttaaaccgatcattattgatgttaaaaatgcgggcgcggaattttacgatcaggaagtcgtggttgataaagatcagctggttaccagccggacaccggacgatctgccagcgtttaaccgcgaggcgttacgcctgctcggtgcctgagtcgcgtagccaaatcatttttttaccaaagcccagcgtgttgtcggtgaatttgatttcatcgagccggatttcccacaccggggccgacagcattctggcaaccggaaagcgacgattgtacgccttgcgcgcgaggtcgctttcctcaccttccagcctgcggatctcacctttaaactgcacaccgcgaattaacgctaccgttttcggctgaccgtttaccgttccggcaaccgcagcctgcggcccactcatctgcgcgtggcgcgttttttcttccgtcaaaatgtagaaggcgactttctgcgcatcaaaaagataaaaggcattagcgcaccagagttccccttcctgctgcacacaccaagtgacaacatgttgttttgccagccaacggctgatggcgatgagtgtttccattgctgttctcttttatactgtgggcctgaccttaacatgcgacgcagacgatgacaccctggtttctttacttgatccgtaccgccgacaataagctttataccgggatcaccacggatgtcgaacgccgctatcagcagcaccaaagcggcaaaggggcgaaagcactgcgcgggaaaggagaactaacgctggtgttttccgcgccagtgggcgatcgttcgctggcgttacgggcggaatatcgcgttaagcaactgaccaaacggcaaaaagagcgtctggtagcggaaggcgcagggtttgcagagctgttaagcagtctgcaaaccccggagattaaaagcgattgaaatgctcgtgatactcaaccaggccggtaacgccattcagcgcgtcatccgctaaacgatgtacctggaaggcgctttcagtgcccggccagcggcaacgcagatcgtgatgcgccgccagttcaaagccgaaacgactgtacagcgccggatcgcccagcgtcaccactgcggcatagccgaactcattaagcgaatcgagtccttcatagaccagttggcgtgccagcccctgtccacggtatttttcatcaaccgccaacggtgccatgccgacccattgcaggtcttcgccctgcacatcaaccggactaaatgccacatagccaatgacctgaccttcgtcatctgtcgccaccagccccagcgtcagaaagccatcttcacgcagatcgtgaaccagcttcgcttccgcatcactttcgaatgagcgacgcagcagggcatcaatacccggcgcatcaatgggaatttctactcgaattagcatggttcacctaccgatgtctgtttggtttcaggcgcggttttcattcccgcctcaacaaaatccgccagttgcagcagcatcatgcgtaaggctttcggcatttgctccagttcaatggcgtccatcaggtttttcacatacagccccagctccgtatcgccttcaatcaccagccgacgctggaagaagagcgtatccggatcttgtttacgcgccgcaatcatcagcagatcgctggcgtcggcactaaaactcacatcagcttgcgcgttctggctaacgaccagtttgccattcaccaccgaggtaaaccattgcaggtcaatatcacgcacatgaatacttaaccagcggccttcaagaaactccagctcgccatcatccagcgcctggcggaattgccagcttaagacctgctcaagaacctggcgttttagcgcaaatggcgtcagttttaccggtacactcaacagagatggccccaaatgcacaatacgggaacgcagtttatccaacacgagttttactccctgtttcaacaatcatcctattttgccatatcagaaaaataacatagcggtataaatcaacaattccatatgaaattgctgctaccaccaatacaactttaactgccttaaatcaaaaattgtcgcagcaaggttaactaaaatcccagttcgttaacatttttgcgttttgatagcgcaaccttcaggaaaaattatggagctgctctgccctgccggaaatctcccggcgcttaaggcggccatcgaaaacggcgcagatgctgtttatatcgggctaaaagatgataccaatgcccgtcacttcgccggccttaactttaccgagaaaaaattgcaggaagcggtgagttttgtccatcaacatcgccgcaaacttcacatcgcgattaacacttttgcgcatccggacggttacgcccgttggcagcgcgccgtggatatggcggcgcagctgggtgccgacgcgctgatcctcgccgacctcgccatgctggagtacgccgccgagcgttatccgcatattgagcgccacgtatcggtgcaggcttcggcgaccaatgaagaggcgattaacttttatcatcgccattttgacgttgctcgcgtggtgctgccgcgcgtgttgtcgattcatcaggtgaaacaactggcacgggtcacacctgtaccactggaagtctttgctttcggcagcctgtgcattatgtcggaaggtcgttgctatctgtcgtcgtatctgacgggtgagtcgcccaacaccataggcgcgtgttctccggcccgtttcgtgcgctggcaacaaacgccgcaggggctggaatcccgcctgaacgaagtgctgatcgaccgttatcaggacggcgaaaacgcaggttatccgacgctatgtaaagggcgttatctggtggacggcgagcgctatcacgcgctggaagaaccaaccagtctcaataccctggaactgctgccggagttaatggcggcgaatattgcttcggtgaaaattgaaggccgccagcgtagcccggcgtatgtcagccaggtggcgaaagtctggcgtcaggctatcgaccgttgtaaggccgatccgcaaaactttgtaccgcaaagcgcgtggatggagacgctcgggtcgatgtccgaaggcacgcaaaccactcttggcgcatatcaccgtaaatggcagtgagaaaagcaatgaaatattccttagggccagtgctgtggtactggccaaaagagacgctggaagaattttatcagcaggccgccaccagcagcgccgacgtgatttatcttggtgaagcggtatgcagcaagcgtcgggcaaccaaagttggcgactggctggagatggcaaaatcgctcgccgggagtggtaagcagattgtgctctccacgctggcgctggtgcaggcatcatctgaactgggcgaactgaaacgctatgttgagaacggtgagtttctgattgaagccagcgatctcggcgtggtgaatatgtgcgctgaacgcaaactgccgttcgtcgccgggcacgcgctgaactgctacaacgcggtgacactgaaaatattgctcaaacagggcatgatgcgctggtgtatgccagtggagctttcccgcgactggctggtgaatctgcttaatcagtgcgatgagctgggcattcgtaaccagtttgaagtggaagtcctgagctacggtcatctgccgctggcctactccgcccgctgctttaccgcgcgttcggaagaccgcccgaaagatgagtgtgaaacctgctgcattaagtatccgaacgggcgcaacgtgctgtcgcaggaaaaccaacaagtgtttgtactcaatggcattcagaccatgagcggctacgtttacaacctcggtaacgagctggcatccatgcagggcctggttgatgtggtccgcctgtcaccgcagggtactgacactttcgcgatgctcgacgccttccgcgctaatgaaaatggcgctgcaccactgccgttgacggcgaacagcgactgtaacggctactggcggcggctggcaggactggagctgcaagcctaagtaaatagctcactttgttaacaactttaactactctttaatgcagtattaaagattaatcggtaacaaagtgagctgttatgactgataaaaccattgcgttttcgctactcgatctggcccccattcccgaaggttcttcagcgcgagaagcattctcccactctctcgatctcgcccgtctggctgaaaagcgcggctatcatcgctactggctggcagaacaccacaatatgactggcattgccagtgctgccacgtcggtattgatcggctatctggcggcgaataccaccacgctgcatctggggtctggcggcgtgatgttgcctaaccactcaccgttggtcattgcagaacagttcggcacgcttaatacactctatccggggcgaatcgatttggggctgggtcgtgctccgggtagtgaccaacggacaatgatggcgctacgtcgtcatatgagcggcgatattgataatttcccccgcgatgtggcggagctggtggactggtttgacgcccgcgatcccaatccgcatgtgcgcccggtaccaggctatggcgagaaaatccccgtgtggttgttaggctccagcctttacagcgcgcaactggcggcgcagcttggtctgccgtttgcgtttgcctcacacttcgcgccggatatgctgttccaggcgctgcatctttatcgcagcaacttcaaaccgtcagcacggctggaaaaaccatacgcgatggtgtgcatcaatattatcgccgccgacagcaaccgcgacgctgaatttctgtttacctcaatgcagcaagcctttgtgaagctgcgccgtggcgaaaccgggcaactgccgccgccgattcaaaatatggatcagttctggtcaccgtctgagcagtatggcgtgcagcaggcgctgagtatgtcgttggtaggtgataaagcgaaagtgcgtcatggcttgcagtcgatcctgcgcgaaaccgacgccgatgagattatggtcaacgggcagattttcgaccaccaggcgcggctgcattcgtttgagctggcgatggatgttaaggaagagttgttgggatagtgtgtcttaacgcgggaagccttatccgagctggcaacgctgtcctacatagacctgataagcgaagcgcatcaggcattgtgtaggcagcagaaatgtcggataaggcaccgctgattactgatacaccggcagtaaattaaagctcgataaaatatgcaccagtgcgttgccgacgccaaacaccagaatcagcgcaatcatcggcttgccaccccagacgcggaatttcgggctgccaaagcgtttacgcgatgcacgggctaacagcgccggaacaattgccgcccagatggtagccgctaaaccagcataaccaatggcgtacaggaatccgttcgggaacaacagcccccccacaactggcggggcaaaggtcagcaatgccgttttcaagcggcccacagccgagtcgtcgaaaccaaacagatctgccagatagtcaaacaaacccagcgttacgccgaggaacgaactcgctaccgcaaagtttgagaacacgaccagcagcagatccagactacggctgttcagtacgccgcttaacgcctgtaccagcacatcaatattaccgcccttctctgcaataccgataaactccggacgcgggatgttacccatcgtcgccagcaaccagatggtatacagcgccagcgccatcagcgtaccgtacaccagacatttcacgatggttttcggatctttgccgtaatacttcatcaggcttggcacgttaccgtgataaccaaacgatgccagacagaacggcagggtcatcaacagatacggtgcataagacgcattgctttcggcgacgttgaacaatgtcgcaggctgcacatgccccagcaggctaccaaaggtgaggaagaaggtaatgactttcgcccccagcacaatcgctgtcatgcgactgacggctttagtgctcaaccacaccacaaacgctaccagcaatgcaaaaccaaaacccgccgcccgtgccgggacgtttagtgacatctctgcgaaggtgtgatgcagaatcgaaccactggcagaaatataggcataggtcaggatatagagcacaaaggcaatggaaatgccgttgaccacgttccagcctttgcccagcaaatctttggtgatggtgtcaaaactcgaaccgattctgtaattcaggttagcttccagaatcatcaagccggaatgcagcatacagaaccaggtaaagatcagcgccgccattgaccagaaaaaccacgccccggacatgaccactggcagagaaaacatccctgcgccaataatggtgccgccgataatcaccacgccgccaagcagcgacggtgacgtttgggtggtggttagtgttgccatgagggcttctctccagtgaaaaatagtgcgactgcgttgttatgcattgcactgtaccagtacacgagtacaaaagacagaaaaaaagccccgatggtaaaaatcggggctgtatatattattttacagattgtgttcgctgttcagcgatgattacgcatcaccaccgaaacgacgacgaccggtagaatcatcacgacgcggagcgcggccttcacgacgttcgccgctaaaacgacgaccatcaccacggccaccttcacggcgttcaccgctgaagttacgaccgccttcacgacgttcgccaccgaaaccacgaccaccgccacgacgctcaccgccagtatgcggctgtgcatcgcccagtaactgcatgttcatcggcttgttgagaatgcgagtgcgcgtaaagtgttgcagcacttcacccggcatacctttcggcagttcgatggtggagtgagaagcaaacagcttgatgttaccaatgtaacggctgctgatgtcgccttcgttagcaatcgcaccaacgatatgacgaacttcaacaccatcatcgcggcccacttcaatgcggtacagctgcatatcgccaacatcacgacgttcacgacgcggacgatcttcacggtcaccacgcgggccacggtcgttacgatcgcgcggaccacggtcatcacggtcacggaattcacgtttcggacgcatcggcgcatctggcggtacgatcagagtacgttcaccctgtgccattttcagcagtgccgcagccagagtttcgagatccagctcttcaccttcagcagtcggctgaattttgctcagcagtgcgcggtattgatccagatcgctgctttccagctgctgctgtactttagcggcgaatttttccagacggcgtttgcctagcagttctgcgttcggcagttctacttccggaatagtcagcttcatagtacgttcaatgttgcgcagcagacgacgctcgcggttctcaacgaacagcagcgcgcggccagcacgacccgcacgaccggtacgaccgatacggtgaacgtaagactcagaatccatcgggatatcgtagttaactaccaggctgatacgctcaacgtccaggccacgggctgcaacgtcggtcgcaatcaggatgtccagacgaccatctttcaggcgttccagtgtctgttcacgcagcgcctggttcatgtcaccgttcagcgcggcgctgttgtagccgttacgctcaagagcttcagccacttccagagtcgcgtttttggtacgaacgaagataatcgccgcatcaaaatcttccgcttccaggaaacgtaccagtgcttcgtttttgcgcataccccagacagtccagtagctctggctgatgtcaggacgggtagtcacgctggactgaatgcgcacttcctgcggctctttcataaagcggcgggtaatgcgacgaatcgcttccggcatggttgcagagaacagagcggtctgatgaccttccgggatctgcgccataatggtttcaacgtcttcgatgaagcccatgcgcagcatttcgtcagcttcatccagaaccagaccgctcagtttagagaggtccagagtgccacgtttcaggtggtccagcagacggcccggagtaccgacaacgatctgcggcccctgacgcagggcgcgtaattgcacgtcataacgctggccgccgtacagagcaaccacatttacgccgcgcatgtgtttagagaaatccgtcattgcttcagcaacctgtaccgccagttcgcgggtcggtgccagcaccagaatctgtggtgctttcagctcaggatcaagattctgcaacagaggtaaagagaatgctgcagtttttccgctccccgtctgggccatacccagaacgtcgcggccattcagcagatgtggaatacactctgcctgaattggagatggtttttcgtaacccagatcgttaagggcttcaaggataggagccttcaggcccagatctgcaaaagtggtttcgaattcagccatgtagtacgtgtgcctcaaaattaatggcggccagtctacataactcatcatgaaattgatcagcaattttcattgaaaagtgtgaaccggctcaaagtaggtgtattaacgaacaacaacgccctcacccgttaaggtgatggcaatcaaaaaagattacgggctgatgtgtacgtcagctattgctggtccgattctgccaggtcatcttggtcctggcccaggagcgataattccaacaatgcgtatcggtgctcaacaaagttatgaacgttgttggcaaccgccagtttgaacagtgccgtggcgctgtccaaatcccccagacttaggtagtacttacctaaatagaagttggtttcactgagatgctcagcgagcgaggtgttatccgttgcgtccgccttgagcctttccattaacgtttgttcgctaatgttgcccaggtagaactcgacaatgttccatccccactgttccttatccgatttttcgaagtgctgtttcaacacttctttagcctgcttctcatcgagcttctgctcggcgagataaagccacagactacggaaaggatcattgggatcgtcttgataaaacgccagcagatcatcttgcgctaacttgtcacgaccgccgtaatataatgcgatcccgcgattcaagtgcgcgtagttgtaagttggatcaagctcaagtacagaatcaaacgcttcataggcagcatcaaaattgcctgcctgcgttaaatatatgcctaagtaattgaatacttcaggcatatccggtcggattgccagcgcttgcgaaaaatcgttacgcgctaatgccctcagaccgagactatcatacaacactccgcgctcatataaaagctgtgcgcgttcgtcatcggttaaagcccgactggcaaggatttgttccatacgtgccagaatcacttcctgctgtaaagtcggttgcaatggtaccgcgaggacttcacttttacgccaggaagtattactgcatcctgcaagcgtaagtgctgtcgcaacgaaacaccagcgcaaaaaaggcttcatttcccactcccgaagaccacggttgaatgaacgtcctgttcccggttgctaacaaggcgtcctgcccggttaaaagccccccgccgcagcggagggcaaatggcaaccttactcgccctgttcagcagccggagcttccggtgctgcagcaggttgagactgctcagtcgcttctttaatgctcagacggatacggccctggcgatcaacttccagaactttcaccggtacttcctgacccatctgcaggtaatcggtcactttctcaacgcgtttgtcagcgatttgagagatgtggaccagaccttctttaccgccgccgatggcaacaaatgcgccaaagtcaacgatacgggtcactttaccagtgtagacgcggcccacttcgatttctgcagtgatctcttcgatacgacgaatagcatgtttcgctttctcgccgtcggtcgctgcaatcttcacagtaccgtcatcttcgatttcgatggtggtgccagtttcttcggtcagagcacggattacagaaccgcctttaccgataacatctttgatcttgtccgggttgatcttgatggtatggatacgcggtgcgaactcagagatatcgccacgcggcgcgttgatcgcctgttccattacgcccaggatatgcagacgcgcacctttagcctggttcagcgcaacctgcatgatctctttggtgataccttcaattttgatatccatctgcagtgcagagataccgtcgcgggaacctgcaactttgaagtccatatcgcccaggtgatcttcgtcgcccaaaatgtcagacagtacaacgtagttgtcgccttctttcaccagacccattgcgatacccgcaacggcagctttgatcggcacacctgcgtccatcagcgccagagacgcgccgcacacggaagccatagaagaggaaccgttggattcagtgatttcagacacaacacgtacggtgtacgggaatttgtccatatccggcatgactgccagcacgccgcgcttcgccagacgaccgtgaccaatttcacgacgcttcggagaaccgaccatgccggtttcgcctacggagtacggagggaagttgtagtggaacaggaaggtatcggtacgttcgcccatcagttcatcaagaacctgcgcgtcacgagcagtacccagcgttgcggtaaccagcgcctgcgtttcaccacgggtgaacagcgcagaaccgtgagtacgcggcagcacgccagtacgcacatccagaccacggatcatatctttttcacgaccgtcgatacgcggttcgcctgccagtacgcggctacgaacaacgtttttctcgatcgcgtgcagaatttcacccagttcgttttcgtccagggtttcgtcttcagcaagcagcgtcgcgatggtttcagatttgatgacatcaacctgcgcataacgctcttgtttgtcggtgatgcggtaagcatcgctcaggcgagcttcagccagtgcagcaacgcgcgcgtttagcgcttcgtttaccggctccggctgccagtcccaacgcggtttaccggcttctttcaccagttcattgatgttctgaataacaacctgctgttgttcatgaccgaacactactgcgcccagcatctggtcttcgctcagcagttgagcttcagattcaaccatcagtacagcggcttcagtaccggcaacaaccagatccagtttgctctctttcagctcgtcctgagtcgggttcagtacgtactggtcattgatgtaacctacgcgggcagcaccaatcgggccattgaacggaataccagacagagacagcgctgcggaagcaccaatcatcgcgacgatatccgggttaacttgcgggttaacagaaaccacggtggcgataacctgaacttcgttgacgaagccttccgggaacagcgggcgaatcgggcggtcaatcagacgcgcgatcagggtttcgccttcgcttgggcggccttcacgacggaagaagctacccgggatacgaccagcagcgtaggtacgctcctgatagttaacggtcagtgggaagaagtcctgacctggtttggcttttttctggccaacaacggtaacgaataccgcggtgtcatccatgctaaccataacagcggcagtagcctgacgagccatcatgccggtttccagagtcacggtgtgttggccgtactggaatttacgaacgatcggattaagcaatgtaatatcctttctctttcttagacagtaccttacggcactggtgttaatacccgatcttctgcgcatcctcgcgactaatgacaaccctaacccagctctatgtgggtaaagcctctcattagccgcgcgaacctctgcaacggaagatcattcatagcaacaatacattagtttccagtgaattgctgccgtcagcttgaaaaaaggggccactcaggcccccttttctgaaactcgcaagaattagcgacgcagacccaggcgctcgatgagctgggtgtaacgtgctacgtctttacgtttcaggtagtcgagcagtttacgacgctgagaaaccatgcgcagcagaccacgacggctgtggtgatcttttttgtgctctgcaaagtggccctgcaggtggttgatctgtgcagtcagcagtgctacctgaacttcggtagaaccggtgtcgtttgcgtcacgaccaaactcagaaacgattttagctgttgcttcagtacttagagacattttaaaactccaaagtatatagaatgaaaggacgccgatctctaattcagcgatcccagtgtacgttacgcaaagtgttaaacaatttacgcgacgttaagcggcagtattctactcgtagcgacctgttatcgcaagacggttaacattacgccgggtattcaaccaccaggcgacgaggcgcaacgcggccttcatcgtcaatttcgcccataccgataaatttgccgttctcaccttccgtgacgcgaaccagtccttccagtggcgcaccagatgtacgaaccgggttaccatttttgaagtaaacagaagacgttaacggaagattcaccaccggatagtccgaagctggactgtccattggcatcagtaatggatcaagtaactccgcggctggaatatcctgctgttcagcttgctcaacaagttcacgcaggtgctccagggtcaccatccgttcaaccggatatttacttaccgccagacggcgcaggtaaataacatgcgcgccacagccgagtttttcacccaggtcatcaatgatggtgcggatataagtgccttttgagcagtgaatttccagctccagctcattgccttcatggcgaataaacagcaattcataaacggtaatcggacgcgcttcacgcggaacttcaatgccctgacgcgcatattcgtacagttttttgccctgatatttcagtgctgaatacatcgaagggatctgttcgatatcgccacggaaagtatccagtgccgctgccagctgctctgcgctaaaggttaccggacgttcttcaacgatctgtccgtcggcatcagaagtatcggtacgctgtccaagacgcgcaatgacccgatagcgtttgtcggagtccagcagatactgggaaaacttcgtcgcttccccgaggcaaatcggcaacatgccggtcgccagcgggtccagcgcaccggtatgcccggcacggttggcgttatatatacgtttcactttttgcagcgcatcgttgctggacataccctgaggtttatccagcaacaaaacgccgttaatgtcgcgaccgcgacgacgaggacgactcattagtcctccttgctgtcgtccgggttaacacgacgttcttcgtcatgtttgaccacgctggtcaccaggtttgacatgcgcatcccttcaaccagagagttgtcgtagaagaaggtcagttccggcacgatacgcaggcgcatcgctttccccagcaggctgcggatgaaaccagaagcttcttgcaacgctttgatgcccgctttaaccgcgtcttcatctttgtcgttgaggaacgtcacatatactttggcatacgccaggtcgcgagacatttcgacaccggaaacggtggtcatcatgcccaggcgaggatctttaatttcacgctgcaggatgagagcgatctctttttgcatttcctgcgctacgcgctgcgggcgaccaaattctttcgccataataaattctcctgacaaaaaaggggctgttagcccctttttaaaattaatttcaggtggaagggctgttcacgttgacctgataagacgcgccagcgtcacatcaggcaatccatgccggatgcagcgtaaacgccttatcccgcatggaaccctaaaaaccttaagcaatggtacgttggatctcgatgatttcgaatacttcgatcacatcgccagtgcggacgtcgttgtagttcttaacgccgataccacattccataccgttacggacttcgttaacgtcatctttgaagcggcgcagggactccagctcgccttcgtagataaccacgttgtcacgcagaacgcggatcgggttgtgacgtttaaccacaccttcggtaaccatacagcctgcgatggcaccaaatttcggcgatttgaacacgtcacgaacttccgccagaccgataatctgctgtttcagttccggagacagcataccgctcatcgccgctttcacttcgtcaatcaggttatagatgacggagtagtaacgcagatccaggctttccgcttcaatcactttacgtgcagaggcatcagcacgtacgttaaagccaaccaggatggcgttggacgccgcagccagggtggcgtcggtttcggtgataccacctacgccagaaccgatgatcttcactttaacttcgtcagtagacagtttcagcaaggagtcggagatcgcttcgacagaaccctgtacgtctgccttcaggacgatattcacttcgtgaacttcgccttcggtcatgttggcgaacatgttctcgagtttagatttctgctgacgcgccagtttaacttcgcggaatttaccctgacgatagagtgcaacttcacgcgctttcttctcgtcacgtacaacggtaacttcatcacccgcagccggtacgccggacaggccgaggatttccaccggaatggacggacccgcttccagcacttcctgacccagttcgttacgcatcgcacgaacacgaccgtattcgaagccacacagaacgatatcgcccttgtgcagagtaccttcacgtaccagaacggtagcaaccggaccacgacctttatcgaggaaggattcgataaccgcaccgctcgccatacctttacgtaccgctttcagctccagaacttccgcctgcagcaggatagcgtccagcagttcatcgataccggtacccgctttcgcagatacgtgtacgaactggctttcaccgccccactcttccggcaggatgccgtactgggagagttcgttcttaacgcgatccggatcagcttctggtttatcgatcttgttcactgcaaccaccaccggtacctgcgccgctttcgcgtgctggattgcttcgatggtctgcggcatcacaccgtcgtcggcagcaacaaccaggactacgatgtccgttgcctgcgcaccacgagcacgcattgaagtaaacgcggcgtgccccggggtgtccaggaaggtgatcatgccgttttcagtttcaacgtggtatgcaccaatgtgctgggtaatgccgcccgcttcgccagaggccactttcgttgaacgaatgtagtccagcagagaggttttaccgtggtcaacgtgacccatgatggtcacaaccggcgcgcgcggttcagccgcagcacccgtgtcacggtcgctcattaccgcctcttccagctcgttttcacgacgcaggataactttatggcccatctcttcagcaaccagctgtgcggtttcctgatcgataacctggttgatggttgccattgcgcccagtttcatcatcgctttgatgacctgagagcctttaaccgccatcttgttcgccagttcgccaacggtgatagtttcgccgatcacaacgtcacggttaacggcctgagcaggcttctggaagccttgctgcagcgaagaacctttacgttttccgcctttaccgccacgtactgctgcgcgtgcttcttcacgatcagcttttgattcagcgtgtttgttgcctttcttcggacgcgctgctttcgcgttacgaccacggccacggccgccttcgacttcacgatcgctttcgtcttctgcctggcgagcatgttgagaagtagtgacgtgataatcgctggaatcttcagtcggttccgcgttatcagtccatttgttttcttccgccatacgacgtgcttcttcagcaacgcgacgtgcttcttcttcgagtttacgacgcgcttcttcttcagctttacgcttgagctctgcagcttcctgctcacggcgggctttttcagcctgggcgtttttagtcatatcgtcttgttgattgctcactttgtctttttccgcagcttcacgtttcgcttgttcagcagcttcacgcttagcttgttctgcggcctcacgttcagctttttgttgcgcctcgcgtttagccgattcttctgcctcacgacgggcttgctcttccgcttcacgctgcgcttgctcttccgctgcaaggcgttcagcctcttgcggatcgcgtttcacaaaggtgcgtttcttgcggacttcgatttgtaccgatttgctttttccaccggtaccaggaatgttaagggtgctgcgtgttttacgttgcagcgtcaatttgtccgggcctgaatttttctgattcaggtggtcaatcaaagtctgtttctcttgtgcagacacagagtcgtcagcagacttccggatacctgcatcagcaaattgctgtaccaggcgttccacggaggtctgtcgctctgcggccagcgttttaatcgttacatctgtcatgctgttccttcctgctacagtttattacgcttcgtcaccgaaccagcaaatattacgggcagccataatcagtgctccggctttttcgtcggtcaacccttcgatatcagccagatcatcaatgccctgttcggcgagatcttccagcgtacaaacgccacgggcggccagtttgaatgccaaatcacgatctaccccttcaaggttcagcagatcgtcagccggtttgttatcaccgaggctttcttcctgggcctgtgcaatggtggccagtgcatttttagcacgctcgcgcagtgcttcaacggtcggctcatcaaggccttcgatttccaacagctctttcatcggcacataggccaattcttccagcgtcgagaagccttcttctaccagaacagtcgcgaagtcttcgtcgatgtcgagatatttggtgaaggtgtcgatcgctgcgtgcgcttccgcctgatgcttagcctgcaggtcgtcaacggtcatcacgttgagttcccaaccgctcagctgcgaagccagacgcacgttctgaccgttacggccaatcgcctgcgccaggttaccggcttcaacggcgatatccatggtgtgtttatcttcatccaccacgatagaagcaacgtctgccggtgccattgcgttaatcacgaactgcgccgggttatcatcccacaggacgatatcgatacgctcgccacccagttcagtagacaccgcctgaacacgcgcgccacgcatacctacgcaagcacctaccggatcgatacgtttatcgttggttttcaccgcgattttcgcacgagaacccggatcgcgagccgctgctttaatttcaatcacttcttcgccgatttctggcacttcaatacggaacagttcgatcagcatttccggcttggaacgagtgacgaacagttgcgcgccacgcgcttccgggcgaacggaatagagcacgccacgaacgcggtcgccagggcggaagttttcacgcggcagcatatcttcgcgcaggatcacggcttcagcgttgttgcccagatccagagagatgttgtcgcggtttacttttttcaccacgccggtgatgatttcaccttcgtgttcacggaactgatcaaccaccatcgcacgttcggcttcacgcactttctgcacgataacctgttttgccgtctgggtagtgatacggtcaaaggtaacagactcaatctgatcttcaacgtaatcgcccaggttcaggctttcatcttcataacgtgcggcttcaagggtgatttccttggtcggctgggtgacttcatcaacaactaaccagcgacggaaagtgtcaaaatcaccgcttttgcgatcgatctgtacgcggacgtcgatctcttgttcatattttttctttgttgctgtcgccagcgcgctttccaatgcttcgaaaatcttctcgcgaggtagcgccttttcattggatacggcttcaactacagccaaaatttctttgttcatcgcgggcttttcacctcatccagactattaaaagtggggaaccaggttcgccttctggatattactcagcgcgaacacttcatctttaccttcgacggtaactgtgatcatttcaccgtctaccgctttgataacgccctgccatttacgacggttttgtaccgccatacggagaaccagagtcacctcttctccgacaaaacgggcgtagtgttcagccgtgaacagtgggcgatcgagacccggtgaggagacttccaggttataagcaacggtgatgggatcttcaacatccagcacagcacttacctggtggctcacatcagcacaatcatcaacattgatgccatcttcactatcaatatagatgcgcagtgtggatgtgcgaccgcgaataaattcgatgccaaccagttcaaaacccagggcctcaactggcgcagtaatcatctctgttaatttttgctctaatgtggacaagcccacccccaagacataaaaaaagggcctaaagcccagttattctgtagtcagataacaaaaaaccccgataaatcggggctttatataactgaaccctataaccgcaactgcggtctggagcactttccagaaggattttttcaaatcccactacgaaggccgaagtcttcacagtatatttgaaaaaggactctaagggaaagtggttgcgggggccggatttgaaccgacgatcttcgggttatgagcccgacgagctaccaggctgctccaccccgcgcctgaaacgtggcaaattctactcgttttgggtaaaaaatgcaaatactgctgggatttggtgtaccgagacgggacgtaaaatctgcaggcattatagtgatccacgccacattttgtcaacgtttattgctaatcatgtgaatgaatatccagttcactttcatttgttgaatacttttgccttctcctgctctcccttaagcgcattattttacaaaaaacacactaaactcttcctgtctccgataaaagatgattaaatgaaaactcatttattttgcataaaaattcagtgagagcggaaatccaggctcatcatcagttaattaagcagggtgttattttatgacgacgattctcaagcatctcccggtaggtcaacgtattggtatcgctttttctggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccaccggcggcctgacctatttcaacacgacgccgctgggccgcgccgtgactggtaccatgctggttgctgcgatgaaagaagatggcgtgaatatctggggtgacggtagcacctacaaaggaaacgatatcgaacgtttctatcgttatggtctgctgaccaatgctgaactgcagatttacaaaccgtggcttgatactgactttattgatgaactgggcggccgtcatgagatgtctgaatttatgattgcctgcggtttcgactacaaaatgtctgtcgaaaaagcctactccacagactccaacatgcttggtgcaacgcatgaagcgaaggatctggaatacctcaactccagcgtcaaaatcgtcaacccgattatgggcgtgaaattctgggatgagagcgtgaagatcccggcagaagaagtcacagtacgctttgaacaaggtcatccggtggcgctgaacggtaaaacctttagcgacgacgtagaaatgatgctggaagctaaccgcatcggcggtcgtcacggcctgggcatgagcgaccagattgaaaaccgtatcatcgaagcgaaaagccgtggtatttacgaagctccggggatggcactgctgcacattgcgtatgaacgcctgttgaccggtattcacaacgaagacaccattgagcagtatcacgcgcatggtcgtcagttgggccgtctgctgtaccaggggcgttggtttgactcccaggcgctgatgctgcgtgactctctgcaacgctgggttgccagccagatcactggtgaagttaccctggagctgcgccgtgggaacgattattcaatcctgaataccgtctcagagaacctgacctacaagccagagcgtctgacgatggaaaaaggcgactcggtgttctcgccagatgatcgtattggtcaattgaccatgcgtaacctggatatcactgatacccgcgagaaacttttcggttatgccaaaactggcctgctttcctcctctgccgcttcaggcgtgccgcaggtggagaatctggaaaacaaaggccagtaattcgacatcaaccctgcccttcaggggtggggttaccttgcttatcctctgtaaactcctttctgagcatcacataatcgaaaacatcatggtttgcatccacaacccgtgagtctcctttatagtgtgcaatcacttcctcaagcgtttgcggctgttccggctttgttacccccatccacgcattaataaggtaattattgtaagctgtcgaaaagatgttgttttccgttgtgcgatccacgccatccccaagaacggggctataccagataaacatcgggacatgatatgcctgctggctagcctccctgcctccatgaaaatagacgttcttcttcgtagggtcacgttccaggccgtggtcggcaaaatacatgaccgaggcgcggcgatcttttaataattcaaaaacctgacctagcaaactatctgtgtaatgaatggagttgtcatagcaggcatcctgatcgtcctgcggttgaaacacggcgctggattgcggataggcgctacaagccggttcatggcttccatttaaatgaagaacaatcagtttcttttgctgcgtattttgctgtaatgcttgcgataaatgcggcaacaacaattcatcaaatcctctgacataaactgtttccatggcgcgcatggcgatactggtaactgctgtaccattctgccgaaaagcggattgcgagcttagccagaaagtctgaaatcctgcttgattagccatattaataatgttgtcggggtaattatgaatgtcatgactcaaaacagaatcagcagttaaagaaaggggaaccgacagcgcagtgtaaggtgcgccgcttattgcttgattaaacagtttgatctgttttctttgtgcttcaacttgcggtgtcgtagagcgtgtatatccatacaaagacatattgtcgacacgtacagactcccccacaatcaacacgtaggtatcaatacctgtatccctgactgataattgaaaatacggcaccgtgtttgcaattgagagtaatctttgatgctctttcgctgctaaagcaaaatagttgagattgaaaaacggcgtataggtagcaaatcgcgacgctagtatatatggactgaacgcttttttattttttgcatctttataagcaaattgacaagcggaaaataaactgcccgaaatgacaatcagcaataatattcctgtcactttttttgtcggcaaggaaacatcatattttattattactgccaaaaaaagaagggataaaaaagcaaaggcacatagataagggatatacatccccagcattttgacaacttcatccggatcactctggagcacactaatcgcaaatccatcattgaaagttgtaccaaaggtacaccatgaatagaggctaatactcatgtctgccgcagtcagtaacacaaatggtgcggcaacaagcaggcgaagcggaagggatgatatacgttttacaaccaggatggtcagaacgaagaacagcaagcgctgaaccatatgcgctccggaagaagcgactaagttcgtaataccaaaaacaataacacaaagatacaacaaccaatgagatttaaaagttctagcaaatttgttgaatactgtcatccagaaatccaagttcacaaccaatataaacaattatcaacaatgtttaattttatatcagacatgtttttcaactctgatccatatcagaacgaaacactgttagttttttctttttaaatgatgcggccattgcgttctcagtaattaaataacattatcaatgcgtctctaaacattacgcagaacgtagccatcagtcgttatactgacaggagcaggatggtttatcgagaagtaaacatatccgtattcgtaccggaactggagttgacacaataaagtgccaattatgtcagtagaagggaaaaatttataactaaggcgtaccggcaccatcgtttcaaggtaccagctacgagtaaagcaactggacgagatacagatacctgacaaccattcctcagaccaggaccaaaacgaaaaaagacgcttttcagcgtctcttttctggaatttggtaccgaggacgggacttgaacccgtaagccctattgggcactaccacctcaaggtagcgtgtctaccaattccaccacctcggcacggatactactttttagttcgggatatcgctggtcggcttagccggagcagctggctgagtttgttcggttttcgccggtgcactcagattttcccattcgctacctttattggttttgttgctattgatgttacccagcaccagactgatgatgaagaataacgttgccagcagcgccgtcatgcgggtcatgaagttaccagaaccacttgaaccaaacagcgtagcggaagcgcctgctccgaaggaggctcccatatcagcgcctttaccttgctgcagcatgatcagaccaacaaggccaattgccacaataaggaaaactactaaaagagcttcatacataatcaacctgttccttgcggagttgccgcgtaccaatgcttcaaccaataaagcgggagtttttaatctttcccactgaagcgggtgtgaatactaaccaaagcgaatgaccttcgcaagggcaattttatcgcattgtatcaactgcggaaaaaaacagcaaaaccgatgtgttcgctgagaaaaaaggcgacaatcgccgcctttttagccagttatctaacgctttaaacggcttttactgcatcggcgatgcggtgtgcaaattcagtcacctgcgcttcgtcttcgccttccaccatcacgcgaattaacggttcggtgccggatttacgcagcaacacgcgtccacggttgcccagcgcagcttcaacctctgcggtcacggctttaactgactcatgctcaagtggatcgccgctacctgcggtgtaacgtacgttaaccagaatctgcgggaacattttcatgccgctgcaaaggtcgtgcaggctcatatggttacgtgccatcgccgccagcacctgcaagccagcaacgatgccgtcaccggtagtagttttatccagcaggatcacatgaccggaattctctgcaccgatacgccagcctttctcctgcattttttccagtacgtagcggtcacccactttcgcgcgcgcaaatggaattcctaactgtttcagcgccagttcaagccccatgttgctcatcaatgtacccacagcgccaccacgcagctggccctgacgaagaccttcacgcgcgatgatatacatgatctgatcgccatcgactttattgccttcatggtcaaccataatcacgcgatcgccatcgccgtcgaaggcaataccgagatccgctttttcagccagcacacgagcctggagcgcgcgaacgtcggtagcccccacttcggcattgatgtttacaccgtttggctcacaaccgatagcgataacgttcgcccccagttcgcgcagcacgttcggcgcgatgtgataagtcgcaccgtttgcacaatccaccacaatcttcagttcactgaggctaagttcgttcgggaacgtggctttgcaaaactcgatatagcgacccgcggcatcaacgatacggctggctttacccagttctgccgaatcaacgcagctgatctccttttccatttccgcttcgatggcctcttctaccgcatccggcagtttggtgccgtcgatagagaagaatttaatgccattatcgtagaacgggttatgcgatgcagatatcacaattccggcctctgcgcggaaggtacgcgtcagataagccacggccggtgttggcatcgggccagtgaagagtgcggaaaggcccgctgccgccagacccgcttccagtgctgactccagcatatagccagaaatacgcgtgtctttaccaataataatcttacgggagccgtggcgcgccagcactttacccgcggcccaacccagcttaagcacaaaatcaggtgtgatcggcgcatcccctacacgaccacgaatcccatcggtaccgaaatatttacgattactcatagcgtttgttttcctttgcagacagagtggcttccaccacccgcatcgcttctacggtttctttgacgtcatgaacacgaatgatgtgcgcgccttgcattgcggcaatgaccgcacaggccagactaccgctcaggcgctcggacggccccacgttcagcagctgcccaatcatcgattttcgtgacatacccaccaacagcggcaggttgaaatggtgaaattcagccaggcgcgccagtaatgaatagttatgggagagatttttaccgaaaccgaatccggggtcgagcaacaatttctcttttgcgatacccgcctgctcgcaacgtgctatttgctcaataaagtagcgattcacttctgcaaagacatcgtcatacttcggagcttcctgcatggtttttggatttccctgcatatgcatcagacaaaccggtaaaccggtttctgcagccgcctccagagcgccaggttcggaaagggagcggatatcattaataatgtgagcgccaactttcgctgactcacggatgacttctggtttggatgtatcgactgagatccagacttcgaagcgttgagcaattgcctcaaccacaggaataacacgttgcaactcttcttcaacgctaacttccgccgcccctgggcgcgtggactcgccaccaacgtcaatgatcgtcgcgccagcgttgatcatcagattcgcatgtttcaccgcatctatcagcgagttatgcgtgccaccatccgaaaaggaatcaggcgtgacgttgaggatccccattacgtgaggatggctaaggtccagtgaagtaccctgggcaaagagtttcatgatgttatccctggtatgaattgataagaaaaaaccccggagcacgccccggggttttcggtacaaatacagtcatctgatgcgggaacttacttgtcgcctaactgctctgacatggtgttacccgggttcggcgtacgcggttcatcaaccggacgaggagcctttggactaccattgtcgccagaattgttagaagcgcctggttcttcccagcccgctggcggacgtacatcgcgacgtgccatcaggtcatcaatctgcggtgcgtcgatagtctcatatttcatgagagcatctttcatcgcatgcagaatatccatattgtcggtcagaagctgacgcgcacgattatagttacgctcaatcagtgctttcacttcctggtcgatgatacgtgcagtttcatcggacatatgtttcgctttcgctacgctacggccgaggaacacttcaccttcttcttccgcgtacagcagtggacccaatttctcagagaagccccactgagtcaccatgttacgtgccaggttggtcgcaactttaatatcgttggacgcaccggtagatacatgttccggcccgtagatgatctcttctgccagacgaccaccgtacagcgtagaaatctggctttccagtttctgacggctggcgctgattgcgtcgccctcaggcaagaagaaagtcacacccagcgcacgaccgcgtgggataatcgtcactttgtgcaccggatcgtgttccggcaccaggcgaccgataatcgcatgacccgcttcgtggtaagccgtcgattctttctgcgcttccgtcatcaccatggagcgacgttccgcacccatcatgattttgtctttcgctttctcgaactcaaccatcgacacaacgcgtttgttgccacgagcagcgaacagtgccgcttcgttcaccaggttcgccaggtcagcaccggagaaaccaggagtaccacgggcaatgattgccgcgtcgatatcgggtgccaatggtacgcgacgcatgtgaactttcaggatctgctcacgaccgcgaacatctggcaagccgaccacaacctgacggtcgaaacggccaggacgcagcagggccgggtcgagaacgtccggacggttagtcgcggcgataacgatgataccttcgttaccttcgaagccatccatctcaaccagcatctggttcagagtctgttcacgttcatcgtgaccaccgcccagaccagcgccacgctggcggcctacggcgtcgatttcatcgataaagatgatgcacggtgccgctttcttcgcctgttcgaacatgtcacgaacacgggatgcacccacaccgacgaacatttctacgaagtcagaaccggagatagtaaagaacggaactttcgcttcgcctgcaatcgctttcgccagcagcgttttaccggtacccggaggaccgaccatcaagacgcctttcgggatcttaccgccgagtttctggaagcggctcggctcgcgcagatactcaaccagttcagcaacttcttcttttgcttcgtcgcagcccgcaacgtcagcaaaggtcgttttgatctgatcttccgtcagcatgcgcgctttgctcttaccaaacgacatggcacctttgccaccgccgccctgcatttgacgcatgaagaagatccagacaccaatcagcaacagcatcgggaaccaggagatgaagatagaagccagcaggcttggttcttcaggcggttcaccgacaaccttgacgttcttggtcaacaggttatccagtaatttcggatcctgaaccggaatgtaagtggtataacggttactatctttcttggtaacgttgatttcacgtccgttgatacgcgcttcacgaacctggtcgttattgacctcttgtaggaaggtagagtaatccaccttacggccattagactcgctgggcccaaagctctggaatactgacatcagcacaacggcaatgaccagccagagtattaggtttttcgccatgtcactcaagggattaacctcttattacaactgtgttaaaaacagcgtcaggatactctatatccagcatctttcaaactttcgtctgaaatctcccggttagggtttacgcccggtcgctacaatatacacttcccgcgaacgtgcacgagaagagtccggcttacgaactttgaccttcgtaaacagggagcgaatttcccttagatactcatcgaaaccttcgccctggaacaccttcactacaaaactgccacctggcgctaatacatcacgacacatttctagcgccagttccaccagatacatggcacgggggatatccaccgccggtgttccgctcatgtttggtgccatatcggacatgacaacctggactttgctgtcgccaacgcgctccagcagtgctttcatcaccagttcatcacgaaaatcgccctgaagaaagtccacaccaacgataggatccataggtaaaagatcgcaagcgatgatgcggcctttgccgccaatttgggtgaccacatattgtgaccaaccacccggagcagcaccaaggtcgacaaccgtcattcccggtttaaagagtttgtcactttgctgtatttcatcaagtttaaaccaggcacgggaacgtaacccctttttctgtgcctgttgaacatatttatcgctaaagtgttcctgaagccagcggctggagctggcagaacgcttcttacctgtcatttaactttcccatggggataactcatcgtaaccaattgcgtaaatttttacgcgcctatttggtgatatatgggagatggcggtagaatgacccgttttcaatcccaacgtaagcaaaaaatacgatgaatctgagtactaaacaaaaacagcacctgaaaggtctggcacatccgctcaagccagttgttctgcttggcagtaatggtttgaccgaaggggtgctggccgagattgaacaagcgttagagcaccatgaactcatcaaggtgaaaatcgccaccgaagatcgcgaaactaaaaccttgatcgtggaagctatcgtgcgcgaaaccggcgcctgtaatgtacaggtcatcggtaaaacgctggtgctttatcgcccaactaaagaacgtaaaatctcgctgccacgctaagattatcctaaagttacacacatttgctgtgtaaaacgaggggttttccgcaggcaggagagcaaaatgccacgctctgttcgttgataaaaggccgcatagcggcctttttcctttctttacaatacatcaacatcttgagtattgggtaattcttacaggtattccaccttaattacttcaaattctacttcgccgcccggcgttttgatgaccacaacatcatcttcttctttgccgatcaggccacgagcaataggcgagtttacagaaatcaggttttgtttaaagtcagcttcgtcatcgccaacgatgcgataagtctgttcttcgtcagaatccagattcagcaccgttacggtagcaccaaaaataacgcgcccattgttgggcattttggtgacatcaatcacctgcgcgttcgacagcttggcttcgatgtctttaatacggccttcgcagaaaccctgctgttcacgagctgcgtggtattcggcgttttctttcaggtcgccatgctcacgcgcttccgcgatagcagcaatgatttcaggacggcgcacagatttcagaaaatccagctcttcgcgtaatttttcagcgccgcgtaaggtcatcggaatagcttgcatttgttatacctcttgaatattcctgatagggcaagtcttcacccaccccggctgttcggcctgcccggcataactccttaccgggaccagaagcaaaaaaataccgacccgggtacaagtcccaggtcagctacaattcacattttgatagtcattttaccctgaagttcccgaagggtcatcgtttactttatagggcgttgcgccgtagtatgacggctcgattccaggttgttagcgcgagattatgcgattttccagatttatcatcggattgaccagctgtatagcgttcagtgttcaggccgcaaatgttgatgagtacattactcaactccccgctggtgccaaccttgccctgatggtgcaaaaagtcggcgcgtcggcccccgctattgattaccacagtcagcagatggcgctgcctgccagtacccagaaagtgattactgcgctggcggcgttgattcaactcggccccgattttcgttttaccacgacgcttgaaaccaaaggcaatgtggaaaacggcgtacttaagggtgacttagtggcgcgatttggtgccgatccgacgttaaaacgtcaggatattcgcaatatggtcgcgactttgaaaaaatctggcgtcaaccaaatcgatggcaatgtgttgatagatacctccattttcgccagccacgataaagcccccggctggccatggaatgacatgacacaatgctttagcgctccgcctgccgccgccatagttgaccgcaactgtttctccgtctcgctctacagtgccccaaagcctggtgatatggcttttatacgcgtggcatcttattaccccgttacgatgttcagccaggtacgcaccctcccccgtggttctgccgaagcgcaatactgcgaactggatgtggtgccaggcgacctgaaccgctttacgctgacgggatgcctgccacaacgttctgagccgctcccgttggcttttgccgtgcaggatggagccagctatgccggtgcaattctgaaagatgagttaaaacaggcgggtatcacctggagcggaacactgctgcgccagactcaggttaacgaacctggaacggtagttgccagtaaacagtcggccccgctgcacgatctgcttaagattatgctgaaaaagtcggacaacatgatcgccgatacggttttccgcatgataggccatgcgcgcttcaatgtgcctggaacatggcgggccgggtcggacgccgtgcgtcagatcctgcgccagcaagccggtgtcgatattggaaacaccattattgccgatggttcagggctttcgcggcataacctgattgcccccgccaccatgatgcaggtgctgcaatacattgcccaacacgacaatgaacttaactttatctccatgctgccgctggcgggctatgacggctctttgcagtaccgtgcaggtctgcatcaggcgggcgtggatggaaaagtctcagcgaaaaccggttcgttgcagggggtatataacctggcgggattcattaccacagcgagcgggcaacgaatggcgtttgtgcaatatctttctggctatgcagtagaacctgcggatcagcgtaatcgccgtattccgttagtgcgttttgaaagccgtttgtataaagatatttatcagaacaattagtcaaaaagaaaccccggcacatggccggggcttcagattattgacaaagtgcgctttgtttatgccggatgcggcgtaaacgccttatccggcctacaaaatcgtgcaaattcaacatattgcaattctcttgtaggcctgataagcgtagcgcatcaggctgatttggcgtttatcatcagtgattaacgcttgtaaatgaactcaacgccttcttcgtcgtcttcgtcccagtcgtcatcccagtcttcatcatcctcttcagcaatctcttcaagctgctggcgatgataatcatcccacatgaattcgactttctctggctgtttcgcttcttcagcctgcacgaccgggttttcaatgataaaggtcatcacatcccagcagagatctttcacgcccagtccactcgccgcagagatcagataatatttatcttcccagcccagcgcctcagcgatcgctttcgctttctcttcggcttctaccttatccagcagatcgatcttgttgaacactaaccaacgcggtttcgtcgccagatcctggctgtatttttccagctcgctgataataatacgcgcgttttcaaccggatcggtgccgtcaatcggatcgatatcgatgaggtgcaacaggacgcggcaacgttccaggtgcttcaggaagcgaatgcccagacctgcgccttccgcagcgccttcaatcagtcctggaatatcggcaacaacgaagctcttttcgttgtccattcgtaccacacccagacttggcaccagagtggtaaacggataatccgccactttcggtttagccgccgataccgcacgaataaaggtcgatttacccgcgtttggcatccccaacataccgacgtcagccagcagcatcagctccagcagcagctcgcgcttatcgcccggcgtgccgttggttttctgccgcggtgtacggttaacggacgatttgaaacgggtattgcccagaccgtgccagccgcccttagcaaccagcagacgctgaccgtgtttggtcatatcgcccatggtttcaccagtaccctggtcgattacacgcgtacctaccggcactttaatcgtcacgtctttaccgcgcttaccggtacagtcgcggcttgcgccattctgaccgcgctctgcacggaaagatttttcaaaacgataatcgataagcgtgttcaggttctcgtcggcttccatccatacgtcaccaccatcaccgccgtcgccgccatccgggccgcctttcggaatatacttttcgcggcggaagctcacgcaaccattaccgccatcacctgcaacgaccagaatcgatgcttcatcaacaaacttcattttattctccgtaaatcattcgcctgcgcggggttgcgataccaccgttgtatgcttacgtaatccgccccaaatacgatgaccaatggcggaatacatcgcgcccgcaaccacgacaaacgcaccgagataacctaaaaggtttaacatcggtctggcgaagaaatcgggccaggccagtgataaaagatctgaaaaaaacagcgtaaacagtggggtgagcgtgatgatcgcgctcacctgcgctgcctgccagcgagccatcgcttccgccagggcgccatatcctaccaaggtattcagtccgcaaaaaattaaacatgcgagctgccagtggctaagctgcgctatcactccaggctttgccagagggaagagcgcaattgtacataaagtgtacagtaaaaacaggatctgcggtgaggccagccgacgcaataaaaccttttgcgccacgccataactcacccaaaccgtcgccgcaccgaccccaaagataactccccaggtgtaatcggtgagctttgtaaatatctcgaccagactggtgttaaaaaacatcaccaggccgctcaggagcatcaatgcccctacaacctgagtgctgcgcattttctctttgaggataaatacgctggcaaccatcatgccaactggcgagagttgcccaatcacctgcgaagcggtcggactcaggtattgcaaggatgagctgaacaggatgaagttcccaaacagcccggcggtcgccactgccaacaaaatcaaccagcgtggcttacgaaacacgcgtaatggcggcaacctcttcttcaccgcaagaatggcacccaggccaatactcgccatcaagaaacggtaaaacacgattgtcggaggttccatcacctccagcacctgcttcattgcgattggcaacgccccccagcaaattgctgtggtgagcgccaaaagaatgccaatgcctgcctgctgcttcataccgtattccctgcaaagcgcatttgcggattaacgtcgcaccatgcgcatttttaccggttatcgaatgtaaaaagccccgcaacgtgttgcggggctttcatccgttaccgggacgcgaaaaacttattcagcttcgatgctgataaatttacggtttttcgggcctttaacttcgaatttcactttaccgtctgctttagcaaacagagtgtggtcacgaccgcaacctacgttagcgccagcgtggaatttggtaccacgttgacgaacgatgatgctacccgccagaacggattcgccaccgaaacgcttaacgcccaggcgtttagcttctgaatcgcgaccgttacgtgtggagccgccagcctttttatgtgccatttgaaatctctcctcaggtcttaggcgctgatgccagtaattttcacatcagtgaaccactgacgatggccctgctgcttacgatagtgtttacgacgacgaaacttaacgattttaactttctcgccacgaccgtgagcaacaacttcagctttgattacgccgccatcaacgaaaggaacgccgattttgacttcttcaccgtttgcgatcatcagcacttcagcgaactcaacagtttcgccagttgcgatgtccagcttttccaggcgaacggtctgaccttcgcttactcggtgttgtttaccaccactttggaaaaccgcgtacatataaaactccgcttccgcgcacaccttttcaatgattcagagtgcgctataaatattcacaatagggcgcgaatattacgcaaaacgcacgcctttgacaagtgctacagtcaatacacgaagaaaaaaaacacaacttgtacggtaacgtttatctgtgccattttttcagtacaatcaccctatattcctaaccataaaccctaagttgcctttgttcacagtaaggtaatcggggcgaaaagcccggcttttgcgatgaatttagaaaaaatcaatgagttaaccgcgcaagatatggcgggtgttaatgcggcaatccttgagcagcttaattccgacgtccaactgatcaatcagttaggctattacatcgtcagcggcggcggtaaacgtattcgtccgatgattgctgtactggctgcacgagctgttggctatgagggaaatgcgcatgtcaccattgctgccctgatcgagtttatccacacggcgactctgctacacgacgacgttgtggatgaatcagatatgcgcaggggtaaagctaccgccaacgccgcatttggcaatgccgccagcgtgctggtaggcgattttatttatacccgcgctttccagatgatgaccagcctcggttcgctcaaagtgctggaagtcatgtcagaagccgtaaacgtcatcgcagaaggtgaagttctgcaactgatgaacgttaacgatccggacatcactgaagaaaactacatgcgcgttatctatagcaaaaccgcgcgtctgtttgaggctgccgcgcagtgttccgggattctggctggctgtacgccggaggaggagaaaggcctgcaggattatgggcgctatctcggcactgctttccagttgatcgacgatttactcgattacaatgccgatggcgaacagttaggtaaaaatgtcggcgacgatctgaacgaaggtaaaccgacgctgccgctgctgcatgcgatgcatcatggcacaccagaacaggcacagatgatccgtaccgccatcgaacagggtaacggtcgccatcttctggaaccggttctggaagcaatgaacgcttgtggatctcttgaatggacgcgtcagcgtgccgaggaagaagcagacaaagccatcgcagcgttacaggtgctcccggacaccccttggcgagaagcactcatcggcctcgcgcacatcgctgttcaacgcgatcgttaatcccctcccctcatcccgcgcagcgcgcgggatggttccagtaagttccataaaaacacttattcagctctataacacctgaaaaatagggatgtgcatctttatatattctgaatattcacactctttacaggaactttttagagcaataggccatcaggagtatagtgatgctcgacagaagaagtgttctgaatgaaagcgactaacttaaggagtgaggaaaaatggaaagtaatttcattgactggcatcccgctgacatcattgcgggtttgcgcaagaagggaacgtcaatggcggcggaatctcgcagaaatggtttgagttcctcaacgctggcgaatgcattatcgcgcccatggccgaaaggagagatgattattgcgaaagccctgggaactgacccctgggttatctggccatcacgctaccatgatccgcagacccatgagtttatcgacagaacgcagttgatgcgtagctacactaaaccgaaaaaatgagtggtctggcggtagccccgcgaacggggctgccagctctcagacgattattcgcctttcacacgctcaatatttgcacctaaagcgcgcagtttgtcttcaatgcgttcgtagccacgatcgatgtgataaatacgatcaaccaccgtcgtcccttccgcaatacagccagccagcaccaggcttgctgatgcacgcagatcggttgccataacctgtgcgccagaaagtttttcaacaccgtgacaaataacggtattgctttcgatttcggcgtgcgcgcccatacggctcagctctggcacatgcataaagcggttttcaaagaccgtttcggtgataaacccggtcccttctgccaccaggttcaacagcgtgaactgggcctgcatatcggtcgggaatgccggatgcggcgcggtacgtacgttaacagccttcggacgtttgccatgcatatccaggctaatccagtcttcgccgacttcgatgtccgctccagcgtcacgcagtttcgccagcacggcgtcgagagtatctggctgcgcgttacggcagataattttgccgcgagaaatcgccgccgccaccaggaaagtaccggtttcgatacgatccggcagaacgcgatagacaccgccgcctaaacgttccacaccttcgatgacgatacgatcggtgccctgaccgctaattttcgcacccagcgtaatcaggaagttcgcggtatcgacgatttccggttcacgcgctgcgttttcaataatcgtggtgccttccgccagggttgcagcacacatgatggtcaccgttgcgccaacgctgactttatccatcacgatatgtgcacctttcaaacgaccatcgacggaagctttaacgtaaccttcttccagtttgatggtcgcgcctaattgttcgaggccagaaatgtgtagatcaaccggacgcgcaccgatcgtacaaccgccaggtagtgaaacttgcccctgaccaaagcgcgctaccagcggccccagcgcccagatagaagcacgcatggttttaaccagatcgtaaggtgcgcagaatacattaacgtcgcgggcatcaatatgcacagaaccattacgttctactttcgcacccagctggcttagcagcttcattgatgtatcgacgtctttcagtttcgggacgttctggatctctaccggttcttccgccagtagtgcggcaaaaaggataggcagagcagcatttttagcgccggaaattgtgacttcgccctggagcttcgttggcccctgaacacgaaatttatccatttagtttgttctcagttaacaattcatatccgctaccggcgaatcgcccatagctcaaaagccgttcagtttgcgatcgcgcgcccactccgcaggggtatacgctttgatcgacacagcatgaatgcggttatccgcaatatattccatcagcggaccatagaccgtctgctgttttttaacccgactcatgccgtcaaacaactcacccacggcaataacctgaaagtggctgccatcgccggaaacgtggacttcctggagggagagagcgttcatcaacacgctctgaatttcattattttccatgggatcttcaatcatcagttaataaaccagcgaaacatcttagagcaaagttgcgctggcataaataagcaaaaagcctcgctgataaatcagacaaggctcgacttgcaggcaggtttgccggacaggcggttaacgccatatccggcctgaaaaaatttaacgaggcagaacatcagcaggcaaattatacaatttcgccagggtatacactttgtcgtttaccccctgaagcgtcacattgttgccctgctttttcgccagatcgataagatggagcagcagtgccagtccccccgtatccacgcgggagacacggctaagatcgatgcaggtaatccccttcaccgcttcctcacgcatttcccaaagcggtagcaaaacgtcctgatccagctctccggataacgccagcgtgtcacccgtctgcatccagctcagtgactcgctcattattttttctcttccagagtgattttctgttgagaaatcgatttcagttgcgcagtcaggccgtcgatacctttggtacgcagcagcgttccccactcgttttgtttggtggtgatcatactgacgccttcagcaatcatgtcgtaagcctgccaattgcccgtctgggagtttttacgccactggaagtccagacgcaccggcggacggccattcgggtcaataatggtaacgcgaataggcacaatggttttatcgcccagcggctgttctggcgcaatctgataggtttgaccgtgatacatcgccagcgcctgaccgtaagcctgcttcaggtactcacggaaagcggcaaagtaggcttcacgttgagcaggggtcgcactcttgtaatactggcccagcaccagcgcaccggcgtatttcacctgtacgtatggcagcagttcctgatcaacaatggtacgcagataatccgggttggcccgaatttgcggttgctcattcttcaggcgatcgaacgttttctgcgccgcctcgtccatcagcttatacggattggtctggtctgccgcggttgccgcactcagaggtgcaatcaccagcaaagcgaccatcattaaacgtttaaacatgcgtcggttctcctgaaattatttcgttgtacccacaggttcagtggtttcattattacctggcgcagcagctggcgcatcgccactattcttattgtcatcgcctttactaccgtaaaggaactgaccaatgagatcttccagcaccatcgcagacttagtgtcctgaattgtatcgccatccttcaggatagcagtccccagttccgggtcttcaaaaccgacgtttaatgccagatattgttcccccagcaggccggaagtacgaatgctcagcgaactggtatctggaatgtggttataacgttgttcaatttccagcgttacgcgcggcagataggttttcgggtccagcgtaatatccgccacccgacccacaacaacgccaccaatactgaccggagagcgcgctttcaggccgccaatgttatcgaacgtcgcataaagcgtgtaggtcggttcagtacgtatggacgtcacgttcgccgccttcaggcaaacaaacagcgccgccagcagtgctgctaataaaaagatacccacccaaatttcattttttttcgtttgcatgaactcaattcccaaacatcaatgcggtcagcacaaaatccagccccagaacagccagagacgagtggacaacggtgcgagtggttgcccggctaatcccggcagacgtcgggatggcgtcgtagccgttaaacaacgaaatccacgtcaccgtgatggcgaacaccacgctcttaatcagacagttgaccagatccatacgccagtcgacggcattttgcattgccgaccagaagaacccgctatcaatgcctttccaactgacgccgaccagagatccgccccagatccccacggcgacgaaaataaccgtcaacagtggtaatgaaataaccccagcccagaaacggggagaaataacccgacgcagcggatccaccgccatcatctccatactggagagttgctctgtagcgcgcatcaggccgatttctgcggttagcgccgaaccagcacgcccggcaaacaacaacgcggcaaccaccggccccagttcacgcagtagcgataacgccaccagcatacccagactggtttccgcactataagtggtcagaaccagataaccttgcagccccaacaccattccgatgaacacgccagaaaccacaataatcagcatcgacaggacgccgacattatagagctggcgcaccagcagcggcgcatgtttgcgaaattccggtttgccgaccagcgcattgaataacattaacccggcccgcccgaacgttctcagggttttaatccctttatgtccgagcgacgccagcgcatttaacagcatgagtggcttaactccctggtaaaagatcagcgtgataatcgccggcaggatagcggaacggaacaggcccgtcagctatcccgtccagaaactgacgtacgcgcggatcaggattcgcctgcaacgcctgggcactgccatgagcgacaatttttttgtccgccaggatccaggcgtgatccgcaatacttaacacttccggcacatcgtgagaaaccaccacacaagtcacgcccagcgcgctgttcagctcagaaatcagcttcaccagtacgcccatggtgatgggatcttgcccaacaaaaggttcatcaaacatgatgagatccggctccagcgcaatcgcacgcgccagcgctgcacgccgcgccatcccaccggaaagttcagaaggcattagtttagccgctccacgcagccccacggcctccagcttcatcatcaccgtactatgcaacaatggcgcgggaagttgggtatgttcgcgcagtggataggcgacgttgtcaaatacgttcatatcagtgaacaacgccccggactgaaataacatgctcatccgtttgcgcactgtatacaggcgcgaacgagacatcgccggaatattctcaccatcgaaaaggatctcaccatgatctggtgcgatttgcccgccaatcagacggagtagcgtcgttttaccgatgcccgatggccccatgatcgccgtgatcttccctcgcggcacggtcagggaaatattatcgaagatgcagcgattgccacgcgtaaaactgacatcgcgcatatcgactaaattcgccacagactgctccataattcacccttcgtcttgcgttgattttctaagcatggcgctcaatttaaccttgaacccaacatatttacagaatattacccgccgtggttagcgaaagctggcatttgttttactttttagccgcataaagtcaaaattaagcatccgttacggctttctgaaaatcttcagcggaccggcgagtatacctgaagaaaggacgttagatgcttttagctacggcactgttaattgttggtttacttttggtcgtttacagtgccgaccgcctggtttttgccgcgtctattctttgccgaacctttggcatcccgccgctgatcatcggcatgacggtggtcagtattggtacatcgttaccagaagtcatcgtctcgcttgccgcgtctctgcacgaacaacgcgatttagccgttggtacagccctcggctcaaacattatcaatatattgctgatcctcggtctggctgcgctggttcgtccttttaccgtccattctgatgttctacgccgtgaattacccttaatgttgttggtcagcgtggtggccggttccgtactctatgacggacaacttagtcgcagcgatggtatctttctcctctttctggctgtgctatggctgctgttcattgttaaacttgcacgtcaggctgaacgtcaggggactgacagcctgaccagagagcagcttgcagagctgccgcgtgacggcggattgcccgtcgcgtttttatggctcggcattgcgcttatcatcatgccagtggccacgcggatggtggttgataacgccacggtgctggcgaattactttgccatcagcgagttgacgatgggtctgacggcaattgctatcggaaccagcctgccggaactggcaaccgcaatagcgggggttcgcaaaggtgaaaacgacattgctgtcggaaatatcattggcgcaaacatttttaatattgtcatcgtgttgggtttacccgcgctgataacgccaggagagattgatccactggcgtacagtcgtgactacagcgtgatgttgctggtgagcattatttttgcgttgctgtgctggcggcgctccccgcaaccgggccgtggtgtaggggtattattaactggcggatttatcgtatggctggcgatgttgtactggttatcgccaatactcgttgaataactggaaacgcattatgtcgcacgtagagttacaaccgggttttgactttcagcaagcaggtaaagaagtcctggcgattgaacgtgaatgcctggcggagcttgatcaatacatcaatcagaatttcacgcttgcctgtgaaaagatgttctggtgtaaagggaaagttgtcgtcatggggatgggaaaatcggggcatattgggcgaaaaatggcggcaacgtttgccagcaccggtacaccttcatttttcgtccatcctggtgaagccgcgcatggtgatttaggcatggttaccccacaggatgtggtgattgctatctctaactctggtgaatccagcgaaatcacggccttaattccagtgcttaagcgtcttcacgtaccgttaatctgcatcaccggtcgcccggagagcagcatggcgcgcgccgcagatgtgcatctgtgtgttaaagtagcgaaagaagcctgtccgttagggctggcaccgaccagcagcaccaccgccacgctggttatgggcgatgccctcgctgtcgcgctgttaaaagcacgcggctttactgctgaagattttgcgctctcacacccaggcggcgcactgggtcgtaaacttctgctgcgcgtaaacgatattatgcatacgggcgatgagatcccgcatgttaagaaaacggccagtctgcgtgacgcgttgctggaagttacccgcaaaaatcttggtatgactgtcatttgcgatgacaatatgatgattgaaggcatctttaccgacggtgatttacgccgtgtcttcgatatgggcgtggatgttcgtcagttaagtattgccgatgtgatgacgccggggggaatacgtgtgcgccctggcattctggccgttgaggcactgaacttaatgcagtcccgccatatcacctccgtgatggttgccgatggcgaccatttactcggtgtgttacatatgcatgatttactgcgtgcaggcgtagtgtaaagattcaaggataaacaacaatgagcaaagcaggtgcgtcgcttgcgacctgttacggccctgtcagcgccgacgttatagcaaaagcagagaacattcgtctgctgatcctcgatgtcgatggcgtactgtcagatggcctgatttatatgggcaataatggcgaagagctgaaagcgttcaatgttcgtgacggttatggcattcgttgtgcgctcacctctgatattgaagtcgctatcattaccgggcgaaaggctaaactggtagaagatcgttgtgccacattggggatcactcacttgtatcaggggcagtcaaacaaactgatcgcctttagcgatctgctggaaaaactggcgattgccccggaaaatgtggcttatgtcggcgatgatctcatcgactggccggtaatggaaaaagtgggtttaagcgtcgccgtggccgatgcgcatccactgttgatcccgcgcgccgattacgtgacgcgcattgctggcggtcgtggcgcagtgcgcgaagtttgcgacttattactcctggcgcagggcaaactggatgaagccaaagggcaatcgatatgagtaaagccagacgttgggttatcattgtgctatcactggcggttctggtgatgatcggcattaatatggccgaaaaagacgataccgcccaggtggtcgtcaacaacaatgatcccacctataaaagcgagcatacggacacgctcgtctataacccagaaggggcactaagctatcgattgattgctcaacacgttgaatattattccgatcaggccgtttcgtggtttacgcagccggtacttaccacgtttgataaggataaaatcccgacatggtccgtaaaagcagataaagccaagctgaccaatgaccggatgctctatttatatggacacgttgaagtcaacgcacttgtgccagactctcaacttcgcagaatcacgacggataacgcgcagatcaatctggtgacgcaggatgttacctctgaagacctcgtcacgttatacggaacaacatttaactccagcggtctgaaaatgcgcggcaacttacgcagcaagaacgccgagctgattgaaaaggttagaacatcctatgaaattcaaaacaaacaaactcagccttaatcttgtgcttgccagctcacttctggccgccagcattccggcatttgccgtaaccggagacactgatcagccgatccacattgaatcggaccagcaatctcttgatatgcaaggcaacgtggttacctttaccggtaatgtcatcgtcacccagggcaccatcaaaattaatgccgacaaagtggtcgttacccgtccgggcggcgaacaaggtaaagaagtgattgacggctacggtaaaccggcaacgttctaccagatgcaggacaacggtaaacccgttgaaggtcacgcttcccagatgcactacgaactggcaaaagattttgtcgttctgacgggtaatgcttatctgcagcaggtcgatagcaacattaagggcgataagatcacttacctggtgaaagagcagaaaatgcaggctttcagcgacaaaggcaagcgcgtaacaaccgttctggtgccgtcgcagctgcaggacaaaaacaacaaaggccagaccccggcacagaagaagggtaattaattcgttatggcaacattaactgcaaagaaccttgcaaaagcctataaaggccgtcgcgtggtagaagacgtcagcctgaccgtcaactccggggaaattgtcggtctgctggggccaaacggtgccggtaagaccaccactttctacatggttgtaggcattgtgccgcgcgatgcgggcaacatcattattgatgatgacgatatcagtctgctgcctctgcatgcacgcgcgcgccgcggtatcggctatctgccacaggaagcctccattttccgtcgcctcagcgtttacgataacctgatggcggtactgcaaattcgtgacgacttgtctgctgaacaacgtgaagaccgcgcgaacgagctgatggaagagtttcacattgagcacctgcgtgacagcatggggcagtcactctccgggggtgaacgtcgccgtgtagaaattgcccgcgcactggctgcgaatccgaaatttattctgctcgacgaaccgtttgccggggttgacccgatctcggttatcgacattaaacgcatcattgagcacctgcgcgacagcggcctgggcgtgctgatcactgaccacaacgtgcgtgaaacactggcggtttgtgaacgcgcttatatcgtcagtcaggggcatttgatcgcccacggcacgcctacagaaatcttacaagacgaacacgttaagcgtgtataccttggggaagacttcagactctgatagggtagaagtttgcgacgttttagcaggagagtacgattctgaacatgaagcaaggtttgcaactcaggcttagccaacaactggcgatgacgccacagctccaacaggcaattcgtctgttgcagttgtcgacgctggaacttcagcaggagctacagcaggcgctggagagtaatccgctgcttgagcaaatcgacactcatgaagaaatcgacacccgcgaaacgcaagacagtgaaacgctggacaccgccgacgcgctcgaacaaaaagagatgccggaagagctgccgctcgatgccagttgggacaccatttacaccgctggtacaccatccggcaccagcggtgactacattgacgacgagctgccggtctaccagggcgaaacgacgcagaccttgcaggattacctgatgtggcaggttgagctgacaccgttttccgacactgaccgcgctattgctacctctatcgtcgatgccgttgatgaaaccggttatctgactgtcccgctggaagatattctcgaaagtataggcgatgaagagatcgacatcgacgaagttgaagccgtccttaagcggatccaacggtttgatccggtcggtgtggcggcaaaagatctgcgtgactgtctgctgatccaactctcccaattcgataagaccacgccgtggctggaagaggccagactgatcattagcgatcatctcgatctgttagccaatcacgacttccgcactttaatgcgcgtcacgcgtctgaaagaagatgtgctgaaagaagccgtcaatctgatccagtcgctcgatccgcgccccgggcagtcgatccagactggcgaacctgagtatgtcattccagatgtgctggtgcgtaagcataacggtcactggacggtagaactcaacagtgacagcattccgcgtctgcaaatcaaccagcactacgcctcgatgtgcaataacgcgcgcaacgatggtgacagccagtttatccgcagcaatctgcaggatgccaaatggttgatcaagagtctggaaagccgtaacgatacgctactgcgcgtgagtcgctgtatcgttgaacagcagcaagccttctttgagcaaggtgaagaatatatgaaaccgatggtactggccgatatcgcccaggctgtcgaaatgcatgaatcgacgatatctcgcgtgaccacgcaaaaatacctgcatagtccacgaggcatttttgaactgaagtatttcttttccagtcacgtcaataccgagggcggcggcgaagcttcctccacggcgattcgtgcgctggtgaagaaattaatcgcggcggaaaacccagcgaaaccgttgagcgacagcaagttaacctctttgctgtcggaacaaggtatcatggtggcacgccgcactgttgcgaagtaccgagagtctttatccattccgccgtcaaaccagcgtaaacaactcgtttgacccaaccgataaggaagacactatgcagctcaacattaccggaaataacgtcgagatcaccgaggcactgcgcgaatttgttacagccaaatttgccaaacttgagcaatattttgaccgaatcaaccaggtctatgttgttctgaaagtggagaaagtcacccacacctcagatgcaacactgcatgtaaacggtggtgaaattcatgccagcgcggaaggtcaggacatgtacgctgccattgatggcttaattgataagctggcacgccagttgaccaaacataaagataaactgaaacaacactaattgtccgggcaattagcatgtgcatggcggtctgttgtgcggcacaacgggccatttgtacggttaatgctccgagcctgttccactgtttgagtgggcaggttcttaggtgaaattatgacaaataatgatacaactctacagcttagcagtgttcttaacagggaatgtacgcgaagccgcgtccactgtcagagcaaaaaacgcgccctggaaatcatcagcgagctggcggcgaaacaacttagcctgccgcctcaggtggtttttgaagctatcctgacgcgggaaaaaatgggcagtaccggtatcggcaatggtattgccattccgcatggcaaactggaagaagatactctgcgcgccgttggcgttttcgttcagctcgaaacgcctatagctttcgatgccatcgacaaccaaccggtggacttactttttgccctgctggtgccggcagaccaaactaaaacgcacctgcatactctgtcgctggtggcgaaacgtctggcggacaaaaccatctgccgccgtttacgcgcagcccagagcgatgaagagctgtatcaaatcattacggataccgaaggtactccggatgaagcgtagttattcggtaatgtctcttttagacgttgtgaggagaaacagtacatggtactgatgatcgtcagcggacgttcaggttcaggtaaatctgtcgccctgcgtgcgctggaagatatgggtttttactgcgtggataaccttcccgtagtgttgttacccgatctggctcgaaccctggccgatcgcgagatttctgccgccgtcagcattgatgttcgtaatatgccggagtcaccagaaatattcgaacaggcgatgagtaacctgcctgacgctttctcaccgcaactcctgttcctggatgccgaccgtaataccttaattcgtcgttacagtgacacgcgccgactgcatccgctttccagcaaaaacctgtcgctggaaagtgctatcgacaaagaaagcgatttgctggagcctctgcgttcgcgagcggatctgattgtcgatacctcagaaatgtccgttcacgagctggctgaaatgctgcgtacccgtctgctgggtaaacgtgaacgcgaactgaccatggtctttgagtctttcggcttcaaacacggtatccctatcgatgcagattacgtctttgacgtgcgcttcttgccgaacccgcactgggatccgaaactgcgtccaatgacaggtcttgataaacctgtcgccgcgttcctcgaccgccacacagaagtacacaattttatctaccagacgcgaagctatcttgagctatggttacctatgctggaaaccaacaaccgtagctacttgacggtcgccattggttgtaccggcgggaagcaccgttcggtgtatattgcagagcaactggcagactacttccgctcgcgcggtaaaaacgtccagtcacgccatcgtacgctggaaaaacgtaaaccatgaccgtcaagcaaactgttgaaatcacaaacaagctgggcatgcatgcccggcctgcaatgaagctgtttgaattaatgcagggttttgacgctgaagtgctcttacgtaatgacgaaggcaccgaggctgaagccaacagcgttattgcgctgctgatgttggattctgccaaaggacggcagattgaagttgaagcgaccggtccacaggaagaggaagcactggccgccgttatcgccctctttaattctggttttgatgaagattaatcttcatcactttgacatacaactcccttcaaactccccccgacaataagaaaatcacgtactgaaatcgttctcaatcaacgtcatttgtacattttgtgcgcttttcactttcagaagaaccttaagaaaaccttaagaggcattgtttaggttttgtttaagttaatcgaccatactggagatcgtcagaaaatatttccaggagatggcatgattcgcttatctgaacaaagtcccctgggcaccggaagacatcggaaatgttatgcgcatccggaagatgcccaacgctgtatcaagattgtctaccatcgtggcgatggtggcgataaagagatccgccgtgagttaaagtactacgcgcatcttggtcgccggttaaaagactggagtggaataccgcgctatcacggtaccgttgagacggattgcggaaccggttatgtctacgatgtgattgcagattttgacggcaagccttccattacgctgaccgaatttgctgaacaatgccgttacgaagaagacattgcacaactgcgccagctactgaaacagctgaagcgttatttgcaggataaccgtatcgtgacgatgtcgctgaagccgcagaatatcctctgtcaccgcatcagtgagtcagaggttatcccggtcgtctgcgacaacattggtgaaagcacattgattccactggcgacctggtcgaagtggtgttgtctgcgtaagcaagagcggttatggaaacgatttatcgcccaaccggcgctggctattgccctgcagaaagatctgcaacctcgtgagagcaaaacgctggccctcacttcgcgcgaagcttaatccagctggtgttgttgcataaacggctcaccgcctaactgatacatctgccgtaaaatccacgcctgacggctacgcacgtagcccgatggcgaggagactttgaaacgaagtggattaggtaatacagctgccagtaatgcagcttccgaccgggtaagtttgctcgcgggtttgtggaaataacgttgtgccgcagcttcgacgccaaacacaccgtcgccaaattcggcgatattcaggtaaaccgtcaggatacgctttttgctccagaccgtttctatccccagcgttaatccggcttccagcccttttcgaacccagctacgcccatcccataaaaagagatttttggctgtctgttgagaaatcgttgaagcaccgcgaatacggttttcattgcgctcgttgtgcgccagggctttctcaatggaagcgacatcaaagccccagtgctcaggaaatttctgatcttctgcggcaatcaccgccagtcccatccacggcgagatttgatccatactgacccagtcagaatgtgccacgtaacgaaaattgccatgcagccaggcgctgacctgtcgctcgaccattaccgctgagaagggaacaggcgcaacgctaaacaacgcgatgcccccgccccagaaaacggcgaggacaaccattaaccgcaaaagaaaacggcgaacgaaactaaacaccgttaagcggcttttactcattcagccagaaccagcacgcgggaaaccagcttatcaatgccgctcgccgcttctgcaatgttctgcgccagcatatatgctggggtggtgacaatcttattgtcttcatcaaccacgatatcatcgacaggacacggcacatgctccgcgcccatctcttccagcacttctgcggtatcgatatcagtaccgatggtcaaacgcagcgggaaatcgaaaattttcggcagcatcgccggggcaatacacataaaaccaagcggttttccggcctgatgcatcgcttgtgccagcgcctttaattcacggtcaacggtgcattcgctaccaagactggcaaaattgcttaaattcttcgccgcgccaaacccccccggcacaatcaacgcatccagttcagcggcatcggcctgggccagaggacggatttcaccgcgcgttattcgtgccgcttcaatcagcacattgcgcgtttccgtcatcgcttcgccagttaaatggttgataacatcaacctgctgcttatccggtgcaaagcagaccgcctgcgcaccgctgcgtgaaatagctaacaacgtcaacaccgcttcatgaatttcagaaccgtcatagacgccgcatccgctcagaattacgccaattttcttcattgtgatcatcctttcgcaattgactgaaacacattaatttttttaataaaaatggtacgcatcacacatttaactgattcatgtaacaaatcatttaagttttgctatcttaactgcgtgcggcctgaaaaacagtgctgtgcccttgtaactcatcataataatttacggcgcagccaagatttccctggtgttggcgcagtattcgcgcaccccggtctagccggggtcattttttagtggcttttgccacccacgctttcagcacttctacgtcgtgacgccactcttctttcatctcttcaatccattcaccgacgttatcttcccaggccggaaggtcaggagactgaatttgctgacccagctgttgcagatggcgtaaccccactgaccccgccgcacctttaattttatgtccttcctcaacaatgccttttttatcctgcgccgtcagattcgactccagcacgctgacatagcccggcatcatcttctcaaacaccgctaacccgtcggtgatcagcttcggtcctacaagttcgagatactgttccagcatgggaatatcgagcaatgcttctgatttactgttctcttctgtcgtcaccgtactctcctcatcatcctgggtatcccagaatttcttgatcatcgcggttagcgccggaacagaaagcggcttactcagcacatcatccattccagcattgaggtactcttgtttgtctttcagcacgttagcggttaaggccaccagcggcggtaaatcctcgcgcggataacgtttcgtcagttcacgagagatatccagcccggtcatatctggcaactgaatatccagcaacaccaggtcgtattcgcccggtttaaacatctccagcgccgccttgccggtcatggcgacatcaacgctgttacctaatttttccagcacagaacgcgcaacaatcacgttcagttcaatgtcttccaccagcagcacattcagcgccggtaaaggcatatcgtcttcatcaaacgcatcatcgacctcttctgctaccgacggtgcgtggatcgtcaacgtaaaggttgaacctttgccctgttcgctggtaaccgtaatatcgccgcccatatttttcgccagacgacgagaaacggccagaccaataccggtgccggtggcaggtttaccgccatgactgtctttcacctggtaatacatggcgaaaattttatccagctcatcctgcggaatgccgataccagagtcttccacttcaaaatgcagcatatcgccttcatcgtagcgcacgcgcacggtaacctggccttgctgggtgaatttgacggcgttactgatgaggttccacaggatctgccgtaaacgcgtcccgtcggtaatgacctgatgcggtaatggcagcgtcggctccaggttaaagcgcaatcctttttgttgcgcctgcaatgcggagagattttccagatcggcaaggaagctggtgaaatcaaccggttgattatcaagctggaccttgcgccgttccatcttatccatgtcgataatatcgttaaagatattccccagcgtgacggccgaaacatggatggtcttgagatatttttcctgctcggcggtgagttcggtatccagcagaatgcggctcagaccgacgataccgttcagcggtgtacgcaattcgtgactgatggtggagataaacgtcgttttgtcgcggctggcccgttcaagcgcatcctgataccgcttacgctcggtaatgtcgcgaccaaagcccatcaaaccgtgacgtttacccacgcggtcgtagtacggcactttacggatttcaaagcaggctttgcgcccgtccgggtaatccagccactgttcataggtcagtgacacattatgacggaacactttttcatcggtttcaatgacttttgcggcggcttccggtgagtaaacatcagcaggtttcaggtgaaccagttgtttttcgctttttccggtcagcagctccatcgcgcggttacagccggaaaactctttatcttcgttacgataaaaaaccaggtcgggtgaagcatcaaggaaggaacgtaagaatgaggattgctgctcgagctgaatttgtgtctcttcgcgctctttgatttcaattttcagttggccgaaggtttcctgcagttctgcttccgctttttcacgaacggcaatttcctgatttagctgggcaatattatcttttaactgaacgttgaggctcaaatcgcgctcgcgcatctcctccagtttttgcaccagccgtgacagacgttgtcgtgactcctccagttgctcgacgaccaccgatagaaagtagaccgcccacggcgtaatcagcaaaccaaagaagatagaacgaataacatcaatgctttcgacctgaccatgcagcaccatggttaccgccatttgtaccacaatggcaagaacgacgagggccagcgccagcaacattgagaagcgcaccagacctaacttcatcatcaggtcaacataatactgcgccagcagacgaatttgcttcattagggaattccttcacgacaacctgccccaataatacccaattctgacagttacgttataaattgtgtgagaaatgcggaattcccctcaacgacctactccgttggaggtagccacggacgtcccagcgccgatccctgtacgccatgttcattcagatagcgatccagctcgaccattcccgtccatcgattttcgcaccacagcggagcaagcagcgtcgggcgacgggcgctggcggaaatgcggtggtagatcacttccggtggcgtatggcgaatcatttctccggcagtgagcgtgtaatcctccagttcaataccgttcaaacgccccgcttcccaggctttcgccataatgctgcctttcacaatatgcagcggatgcagctttatgccgtccacgccggtttcaaccactcgctccagcgtttgcaaacattcagcctgcccttcgccaggcaggccgacaattaagtgggaacacaccttcagcccgcgctgacgtgccagctgggttgtacgctgataacaggcaaaatcatggccgcggttgatgcgatgcagtgttttgtcgtgggcggtttgtagccccagctccagccacacttcgtaaccctggtccttatattcgcaaagcagatccagcaccgcatccggcacgcagtccgggcgggtacccacacacaaaccgacaatattggcctggctcaccgcctgctgatacatagaacgcagcacctgaacttccgcaaaggtgctggtatacgcctgaaagtaggccagatagcgtttagcgcggttaactaaattcgcctggtgcgccagttgctcggcaatggaacgatgctgctgcgcttcatcggcaaacgaggcaacattacagaatgtgcagccaccacgcccgatggtaccgtcacggttagggcagctaaaaccgccgtgcagcgtcagcttatgcaccttttgcccataacgacgggtgagatcaccaccaaacatattgactaatttctgtaactgcataatctgatagaccgcgccttgaaaagaggccaaagcctgccatttttagctcaattcggcgatgacctggatcaatcgtcccggcctgcttttatcaactgcataatcaatcaaaattaccgaaatttcatgcataatcacataaatcacttttgcttatcttgtgtcagatttttttatctcctgatggattttaggcaaaaacagtagcatgaaacgtcattaccaattaaggcagtataaaatgctggttttgtcgtcagttcaaggcaggataagggttaacacacctttatgacagtcaggaattgactgtttctctaacgacttcccttttagccttaaagataaaatccattttaatttcagtcatttaataaagaattttgcgctaaagcacatttctgtaccaataagcttgccatttgacctgtatcagctttcccgataagttggaaatccgctggaagctttctggatgagcagcctgctcatcatatttatgcagtaattgagatcccctcttcaccgtattaaccgatgcgaaaaggacaacaagggggcgaatgcgaggcgcgcgtatgacacgcaaaccccgtcgccacgctctttctgtgcccgtgcgcagcggttcggaagtggggttcccgcagagcctgggggaggttcacgatatgttgtacgataaatcccttgagagggataactgtggtttcggcctgatcgcccacatagaaggcgaacctagccacaaggtagtgcgtactgcaatacacgcactggcccgcatgcagcaccgtggcgcgattctcgccgatggtaaaaccggcgacggttgcggcttgctgttacaaaaaccggatcgcttttttcgcatcgttgcgcaggagcgcggctggcgtttagcaaaaaactacgctgtcgggatgctcttcctgaataaagatcctgaactcgccgctgccgcacgccgcatcgttgaagaagaactgcaacgcgaaaccttgtcgattgtgggctggcgtgatgtccccactaacgaaggcgtgctgggtgaaatcgccctctcctctctgccacgcattgagcaaatttttgtgaacgccccggcaggctggcgtccacgcgatatggagcgccgtctgtttatcgcccgccgccgcattgaaaagcgtctcgaagccgacaaagacttctacgtctgtagcctgtcgaatctggtgaacatctataaaggtctgtgtatgccgacggatctgccgcgcttttatctggatcttgcggacctgcgtctggaatcggccatttgcctgttccaccagcgcttctccactaacaccgtaccgcgctggccgctggcgcaaccgttccgctatctggcgcataacggtgaaatcaacaccatcaccggtaaccgccaatgggcgcgtgcgcgtacttataaattccagacaccgcttatccctgacctgcacgacgccgcaccgttcgtcaacgaaaccggctctgactccagttcgatggataacatgctggaactgctgctggcaggcgggatggatatcatccgcgccatgcgtctattagtaccacccgcctggcagaacaacccggatatggacccggaactgcgtgccttctttgactttaactccatgcatatggagccgtgggatggcccggcgggcatcgtgatgtccgacggtcgttttgccgcctgtaacctcgaccgtaacggtctgcgtccggcgcgctacgtcatcaccaaagataagctcatcacctgcgcctctgaagtcggtatctgggattaccagcctgacgaagtggtcgaaaaaggccgcgtcgggccaggcgaactgatggttatcgacacccgcagtgggcgtattctgcactcggcagaaaccgatgacgatctgaaaagccgccatccatataaagagtggatggagaaaaacgtccgccgactggtaccgtttgaagatctgcccgatgaagaagtgggtagccgcgaactggacgacgacacgcttgccagctaccagaaacagtttaactacagcgcggaagagctggactccgtaattcgcgtactgggcgaaaacggtcaggaagcggtcggttcgatgggcgatgataccccattcgccgtgctctccagtcagccgcgcattatttacgactacttccgccagcagtttgcccaggtgactaacccgccaatcgacccgctgcgtgaagcgcatgttatgtcgctcgccaccagtatcggtcgtgaaatgaacgtcttttgcgaagcagagggccaggcgcaccgtttaagctttaaatcgccgattctgctctactccgatttcaaacagctcacgacgatgaaagaggagcactaccgcgcagatacgctggatatcacctttgacgtcactaaaaccacgctcgaagcgacagtcaaagagctgtgcgacaaagccgaaaaaatggtacgtagcggcaccgtgctgctggtgctctccgaccggaatatcgctaaagatcgcctgccggttccagccccgatggcggttggcgcgatccagacccgtctggtcgatcaaagcctgcgttgcgatgccaacatcatcgtcgaaaccgccagcgcccgcgatccgcaccacttcgccgtgttgctgggcttcggcgcgacggctatttatccataccttgcctatgaaacgctgggccgcctggtagacacccatgcgattgccaaagattatcgtaccgtgatgctcaactaccgtaacggcatcaacaaaggcttgtacaaaatcatgtccaaaatgggcatctccaccatcgcctcttaccgctgctcgaaactgtttgaagcggtcggtctacacgatgatgtagtgggcctgtgcttccagggggcggtcagccgcattggtggagcaagctttgaagacttccagcaggatctgctgaatctgtcgaaacgtgcctggctggcgcgtaagcccatcagccagggcggtctgctgaaatacgtccacggcggcgaataccacgcctacaacccggacgtggtgcgcacgctgcaacaagcggtacaaagcggcgagtacagcgactatcaggaatacgcgaagctggttaatgagcgtccggcaaccacgctgcgcgatctgctggcaattacgccgggtgaaaacgcggtcaacattgctgatgttgaaccggcaagcgaactgtttaaacgctttgataccgccgcgatgtctatcggcgcgttaagcccggaagcccacgaggcgctggcggaagcgatgaacagcatcggcggtaattcgaactccggtgaaggcggcgaagacccggcgcgctacggcaccaacaaagtgtcgcgcatcaagcaggtggcttccggtcgctttggggttactccggcgtatctggtcaatgccgacgtcattcagattaaagtcgcccagggcgcgaagccaggcgaaggcggtcagttgccgggtgataaagtcacgccttacatcgccaaactgcgctattcggtgcccggagtgacgctgatctccccgccgccgcaccacgatatctactctatcgaggacttagcgcagctcattttcgacctcaagcaggttaacccgaaagcgatgatctccgtgaagctggtttccgaaccgggagtaggcaccatcgcgactggcgtggcaaaagcttatgcggacttgatcaccatcgcaggctatgacggcggcaccggcgcaagtccgctttcatcggtgaaatacgcaggctgtccgtgggagctggggcttgttgaaacccagcaggcgctggttgctaacggcttgcgtcacaagatccgtttgcaggtcgatggcggcctgaaaacgggtgtcgatatcatcaaggcggcgattctcggcgcagaaagcttcggcttcggcactggcccgatggtggcgctcggctgtaaatatctacgtatttgccatctgaacaactgcgcaacgggtgtagcaactcaggatgacaaactgcgtaagaaccactatcacggcctgccattcaaggtgacgaattactttgagtttatcgcccgtgaaacccgcgagctgatggcacagcttggcgtaacacgtctggtggatctgattggtcgcaccgacctgctgaaagagctggacggtttcaccgccaaacagcagaagctggcgctgtcgaagctgctggagactgccgaaccgcatccaggtaaggcactctactgcaccgaaaacaacccgccgtttgataacggcctgctgaacgcgcagttgctgcaacaggcgaaaccgtttgtcgatgagcgccagagcaaaaccttctggttcgatattcgcaacaccgaccgttctgtcggcgcgtcgctttcaggctatatcgcccagacgcacggcgatcaggggctggcagccgatcctatcaaagcgtacttcaacggcaccgcaggccagagcttcggcgtgtggaacgcgggcggcgtggaactgtacctgaccggtgatgccaacgactatgtcggtaaaggcatggcgggcggcttaatcgccattcgtcctccggttggttccgccttccgcagccatgaagcaagcattatcggcaacacctgcctgtatggcgcgaccggtggtcgtctgtatgccgcaggccgcgcgggtgaacgtttcggcgtgcgtaactccggtgctatcaccgtggtagaaggcattggcgacaacggttgtgaatatatgacgggtggtatcgtctgcattctgggtaaaaccggcgttaacttcggtgcgggcatgaccggcggtttcgcttacgttctcgatgaaagcggcgatttccgcaaacgcgttaacccggaactggtcgaggtcttaagcgttgacgctctggcgatccatgaagagcatctgcgtggtcttatcaccgagcatgtgcagcataccggctctcagcgcggtgaagagattctggcgaactggtcaaccttcgccactaaatttgcgctggttaaaccgaagtccagtgatgtaaaagcactgctgggtcaccgtagtcgtagcgcagctgagttgcgcgtgcaggcgcagtaaggggtagcaacaatgagtcagaatgtttatcaatttatcgacctgcagcgcgttgatccgccaaagaaaccgctgaagatccgcaaaattgagtttgttgaaatttacgagccgttttccgaaggccaggccaaagcgcaggctgaccgctgcctgtcgtgcggcaacccatactgcgagtggaaatgcccggtacacaactacatcccgaactggctgaagctcgccaacgaggggcgtatttttgaagcggcggaactgtcgcaccagaccaacaccctgccggaagtttgcggacgagtctgcccgcaagaccgtctgtgcgaaggttcctgcactctgaacgatgagtttggcgcggtgaccatcggcaacattgagcgctatatcaacgataaagcgttcgagatgggctggcgtccggatatgtctggtgtgaaacagaccggtaaaaaagtggcgattatcggcgcaggcccggcaggtctggcgtgtgcggatgtcctgacgcgtaacggcgtaaaagccgttgtcttcgaccgtcatccagaaattggcgggctgctgaccttcggtattccggccttcaagctggaaaaagaggtaatgacgcgtcgccgtgaaatcttcaccggcatgggtattgaattcaaactcaataccgaagtgggccgcgacgtacagctggacgatctgctgagtgattacgatgccgtgttccttggcgtcgggacttatcagtcaatgcgcggcgggctggaaaacgaagacgccgatggcgtgtacgcagcgctgccgttcctcatcgccaacaccaaacagttaatgggctttggtgaaacccgcgacgaaccgttcgtcagcatggaaggcaaacgcgtggtggtccttggcggtggcgacactgcgatggactgcgtgcgtacgtccgtgcgccagggagcgaagcacgttacctgtgcctatcgtcgtgatgaagagaacatgccgggttcccgccgcgaagtgaaaaacgcgcgggaagaaggcgtagagttcaaattcaacgtccagccgctgggtattgaagtgaacggtaacggcaaagtcagcggcgtaaaaatggtgcgtaccgaaatgggcgaaccggacgccaaaggccgtcgccgcgcggagatcgttgcaggttccgaacatatcgttccggcagatgcggtgatcatggcgtttggtttccgtccacacaacatggaatggctggcaaaacacagcgtcgagctggattcacaaggccgcatcatcgccccggaaggcagcgacaacgccttccagaccagcaacccgaaaatctttgctggcggcgatatcgtccgtggttccgatctggtggtgaccgctattgccgaaggtcgtaaggcggcagacggtattatgaactggctggaagtttaagcgaggtaacaatgaattcgccagactgtgtctggcgaatcaaattactgacgaagtgcgcgttgttttctggcaaatgcggcatgagcgtttgacctttcctataatagggataattttcaataaattgtgctttgttcaccaagtctgatgagtgaagcacatcaagcaatttctcatttacaatccgtctcaattacttgttaacacctctgacaataccgattctgcaagctattcagtcttttcattccatgtaaattgtctcgatattaatatacaaaatatgaatataaaaaaccaatatattatccttaattatctatatattttcctatttttcagcgcaaacattcatgtaatgaataattatcaccacaaaccacctcaccagcaccttattattcacatgatcgtaactataaaattcattaaataaatacatcccagcaagttggctatttctgaacgagttatttatttacattcacaaacagatatatatactgcttcagctttttattttaaaaaataaatttgttattaaggatatgttcatatgtttttcaaaaagaacctcacaacagctgctatttgtgcagcactttctgttgcagcattcagtgccatggcaacagattcaactgatacagaattaactatcatcggcgagtatacccctggtgcatgtaccccagttgttacgggcggcggcattgttgactatgggaaacatcataacagtgcgctgaatccgaccggtaaaagtaataaactggttcaactgggccgcaaaaacagcacattaaatataacctgcacagcaccaacgctaattgctgtaacctccaaggataaccgtcagtcgaccattgtagcgttaaacgacacatcctatattgaaaaagcttatgatactctcgtagatatgaagggaacgaaaaacgcctttggtttaggttctgcgcctaatggacaaaaaattggcgctgcatccattggtattgacaggtctaatggtgggattcacgcggcggacgatacaggtgaaattcctgtcgacctgattcaaactgaccactggtcagcagcgacccccacatggaaagcctcatctaatggcgcattctgctcgctgacaagttgctcagcaatcgagcgcggttattctgttgcaaaaacaggggaactgacacctgttgctattacagcggtcaccttcccgttactgattgatgctgcggtaaatgacaatactattcttggttctgatgaaacgatcaaactggatggtaacgtcactatcagcgttcagtatttataagaacttgtaatacagtttttatttttacgcattaaccagttagctataactcggacagattatgccctatgacatggtctgtcttaatcaatctcatcgcaaacagtgcataacatatattaacaatatgtttctgcgttatttatcattattacaggagttttaatttaaatgctcagacacattacattcactgtatttataacaacatcaatgaataccttagccacagggatggttcctgaaacatcagtattgctggttgatgaaaagcgtggtgaagctagtattaatattaagaatacagatgatcatccttcattgctttacaccaccattgttgatttgcctgaaagcaataaatcaattcgtttaatcccgactcagcccgttattcgtgttgaagccggtcaagtacaacaggttcgatttttacttcaggcgactgttcctctgcaatcagaagagctgaaacgcgtaacgttcgaaggtattccaccaaaagatgacaagagcagcagagttactgtttcaattcgtcaggatctacctgtactgatccacccggcttccctgccggaagagcgagagacctggaaattcctggaatggcgtaaaaatggcgaccaaattgagattagcaaccccagtaattatgtcgttcgtatgaccttacaatttaaaacgctcccttcaggaaaaacgggggctataaataagacctattttctaccacacaccagtacaactactgcattaacaaacgctacggatacaaaagtcgagttttacccagccagccgatatggttatcgcggtaataaatatgtcactgacttaaaataactttgcctggagcgacaaggatgttaaaaaaaacgttactggcctacaccattggttttgccttttctcccccagccaatgcagatggtatagagattgccgctgttgattttgatcgggaaacattaaaatcactaggtgtagatcctaatatatcgcattatttttcccgttcagcccgttttttgccaggtgaatattcactgatagtatcagtaaatggcgaaaaaaaaggcaacattgctacgcgctttgatgaaaatggcgacatttgtcttgatcaggcatttctgcaacaagccggtttaaaaattccttctgaagaaaaaaatggctgttacgactatatattgtcctacccgggtaccacaatcacaccattacctaaccaggaagcgttagatattatcgtttcaccacaggcgatcattcccatagggttggatctcacaaacgcagcaactggtggaacagctgcgctgctaaactactctctgatgagcagccgtgcagaattttctaatgggagttcggactactcccaggctgcacttgaaggcgggattaatattaatgactggatgttacgcagccatcagttccttacacaaacaaatggcacattcagtaaccagaactcgtcaacctaccttcaacgtacctttacagatcttaaaacactcatgcgagcaggtgaagttaacctcaataatagcgtgttggaaggagccagtatttacggtatcgaaatcgcaccggacaacgcattgcaaaccagcggcagtggtgtgcaagttactggtatagccaacacctctcaggctcgtgtcgagattcgtcaacaaggagttttaattcattccattctggttcctgcgggcgcattcactatccctgatgtacctgttcgcaatggtaatagtgatcttaatgtcaccgttgtcgaaacagacggtagttcgcacaactatattgttccctccaccctgtttaatcagcatgtagaaagcttccagggttatcgcttcgcgatagggcgggtagacgatgactatgacgaatcaccttgggtaattagtgcatcgagcggatggaatctgacacgctggagtgcaatgaacggcggcgttatcgtagcagaaaattatcaggcggcatcaatccggtcgagtctggttcccctgcccgatttaacagtgagcagccaaattagtacatcgcaggatacgaaagactcactgcaaggacagaaatatcgtcttgacgcgaactacaatctcccattttcacttgggctaacaaccagcctcactcgatctgatcgccattatcgcgaactgtctgaagcgattgatgatgattataccgatccgactaaaagcacttatgcgcttggtttaaactggtctaactccattctgggtggtttcaacatcagtggctataaaacatatagttacgacggtgacaatgactcaagcaaccttaatattaactggaacaaagcgttcaaacacgccacggtttccgtcaactggcagcatcaacttagtgcttcagaaaataatgaagacgatggtgatctgttctacgtcaacatcagtattccatttggcagatcaaacaccgccacactgtatactcgccatgacgatcataaaacccactatggtactggtgtcatgggagtcgtctcagatgagatgtcctactatgtgaatgctgaacgagatcacgacgaacgtgaaacgagcttgaacggcagtatcagttccaatctccattacacccaagtcagccttgccgcaggagcaagcggcagtgatagccgtacttacaacggtacgatgtcaggtggtattgccgtacatgatcagggagtgaccttttcaccgtggactatcaatgacactttcgccatcgcaaaaatggataacaatattgcaggtgtcagaattacatctcaggcaggcccagtatggacagattttcggggtaatgccgtcattccatcaatccagccgtggcgaacatcaggagttgagatcgataccgccagcttgccaaaaaatgtcgatatcggtaacggcacaaaaatgatcaaacaaggccgtggtgcagtagggaaagtcggattcagtgcgataacacaacgccgtgcattactcaatatcacactttccgacggcaaaaaactgcccagaggcgttgcgattgaagatagtgaaggcaactatctgacaacatcagtggatgacggtgttgtattcctcaataacatcaaaccggacatggtgctagatataaaagatgagcagcaatcatgccgtattcaccttacattcccagaagatgcaccaaaagatgtgttctatgagacagcaacaggagagtgccaatgaaacggataataacaggatgcctgctgctgaacttcgccatggccgctcaggcagagtgtaatatctccagtagcatacaaaatatcgactatggcaaacgaagtgctgccatgcgccaagttgaccggggtaaaacaacacaattagcagacagaacaatcacgctggtaatgcaatgcgatcaggacgctcatattcgtgttcagttgaataccgctaatatttccaacaacggatttggatttggcccgaatggttcattaaatctgatcgccagcgatgcattttcaggtagtaacaatctcgacctggcgttagccagtggcaaaaatgacaatccgggcagcacaggaacagcatcaattagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttagtacttcccccaataattggctggtgtttatgcaaaatggtcaagaagtggtaattgatagcggtaaaagcgttagcctcacactgacaatggctccagcttttaaggatgaaggggaactaaccgacatgacagatattacaggcaatctgacggtcctggtggaggcaaaatgaacaatgtaaaattactgattgccggaagtgccttttttgccatgtcagcgcaagccgctgatagagtatcaattgacgttaaggtgactctggaagctgcagcttgtactccaatactaagcaacggcggagttgttaacttcggtagtcattcagtcaatagactttcaacgcagcactacacacagattggaacacgtaatattaatatgactataacttgcgaatccgctaccggcattgcgattaccgctcgtgatacacgaatggatagtatgaccaccggaaaagatagtgggggtcagagtggtgtaaaatataccttaaatggcggaggttatattagccagacaacgcgcttattcggcttagggaaaacaaaagataataaaaatatcggtagttatgccgtgttaattgatagcaacaacattagtgccagcaatggtagccagacgttagctgtatcaatagcaggtgcagatgccgtcataacagggcaaaaaagagcatggcaaacgctcaccgcttatccgcttgcagtcgatcaaagctattattacacctttgtaaaaccaggtgaaacaaccccaactcctgtaacgaacgccattataccgcttcaggtgagcgcatctatcgcgaatgatttaggcggttcagaaaaaatcgaacttgatgggaaagctgtgataagcgtagtctacttgtgataacaatgccggacaggagtactatcaggcattcgttttatacgatcggttaatgtttcaggaaagctcttcgcatatcttggggaaagtaaatgtaatacgctgttcttaattgttcagtgctcaccccccagagtatagctcattccattattcaacttagctccatataaagggacagataatggaatcgctctcagaaggaaccacagcaggctaccagcaaatccacgacggtattattcatctggtcgatagcgcccggacggaaacggtacgtagcgttaacgcgttaatgaccgcgacgtaccaggaaattggccgacgaattgtcgaatttgaacaaggtggcgaggccagggctgcgtatggtgcgcagctaatcaagcgactatcaaaggatttatgtctaaggtataagcgtgggttctctgcaaaaaacttacgccaaatgaggcttttttacctcttttttcaacatgttgaaattcaccagacaatgtctggcgaattaacaccattgggaattccgcagacaccgtctgcagaattcccatcggcaaagatttggcagacgctgtctgccaaatctttccccttgcccaggtccacctacgtccgtttactttccgttaaaaacgctgacgcccgcagcttttatgaaaaagagacgctccgctgtggctggtctgttcgccagctagagcggcaaattgcgacccagttttatgagcggacactactgtcacatgacaaatcagccatgctgcaacaacacgctcctgccgagacgcatattcttccgcaacaggcgatacgcgatccctttgtgctcgaatttctggaattgaaagatgaatattcagaatccgattttgaggaggcgctgatcaaccacctgatggatttcatgctggaacttggggatgattttgcctttgttggtcggcagcgaaggttacgcattgatgacaactggtttcgtgtcgatctgctgtttttccaccgccgtttacgctgcctgctaatcgtcgatctaaaagtgggcaaattcagctatagcgatgccggacagatgaatatgtatctcaactacgccaaagagcactggacgctaccggatgaaaatccgcccatcggtctggttctctgtgcagagaaaggagccggagaagcgcattatgctctggcaggtttgcctaacaccgttctggcaagcgaatataagatgcaactacctgatgagaaacgactcgcagatgaactcgttcgaacacaggcggtgctagaggaaggctatagacgccgttaatttcagcggtttcgaattctgcagacagtgtctgcagaatctttaaaacgaactaagttttaagccattaaatcagccttaaccttcaccacaacctttttaatctctccaggctcgccgacaacgcatcctggtttatgcggttcacctggcataaacacggcgaacattcccggttttaagatgatggcttgctcgttatcaatggtgctgcaaagctgataatcatcctcatggtggaactcttcacactgacgcgcagtgcctgccatgccaaacagaatccgttcctcaccgtttaataacagctggatatcaatgtattgctcgtgcaattccgcttttttctcgacgggcgattgagtgttaaacgtcatgacattcataaagatattgtcgccctgtaattcgtaacgacccggcgctttttcttgcggtctggcagctaatgccagcgttaacgcgtcctgtaacgcaggatgtaacccagcagacggtaatgactgtacttcacccatcatcataatttttctccctgggccaacagcgcagccccaagtaaacctgcatcatggcggtaatgcgccgccagtaaatcaacatgaaatgccgctggctcctgcgccagatacgtttccaccagcgccagatacccttctgccagaccaacgctgccaccgaccaccacgcactggcaatcagttgtggctttaatatcagcgatcagccttgcaagcgtacgtgcggagcggtgaatcagctgctgcgcctgctcgtcaccctgcccggcgcgcgtgaaaatagttttcgcatccgcgccagccaactccccctgcgctgccgctgcaatgccgcgaccagaagcaatcgcttccacgcaacctgtgcgtccacagccgcagactgggccgtgtggatcggcaagcgtatgcccgatatgccccgccagaccgccagggccggtaagcagtttgcagccgctcactacaccgccgccaacgccggtggaaacggtgataaagaccatatcggttatatcgccatccagcgcctgaaactccgcccatgctgcggcctgcgcgtcgttaatggcaatggtcggcaaattggtaagttgttccagcgttttgactaacggaaagtgtagcaatccaccaagattatgcggattaagcgccagcaagctgccgtcacggattatcccggtcgaagcgatggcaacccgctgcgcatgagcttgcaacggagagactaatgcggataaggcatcacgcaaggcttctggtgtctggctggctggcgtaggaagttcacgacgatcgcggatctgcccgtcagcgccaatcagcgcggcggcaagtttagtaccgccgatatcaatcgccagtgtggtcatagcaccgcctttttcatcgctgtgttgtaccactgacaaatgtgctcaagacgcgtgattgcagaaccgaccgtcaccgcccacgcgccgtggcgcatcgcatccgccgcctgagcaggcgtgttgtaacgcccttcggcaatcacccgacatccggcgtcgctcaacgttttcaccagcgccagatccggctcttctggcgtttcaggcgtggtatagccagaaagcgtagtgccaataatttcggctcccagcttttggcatgccaggccgtcttccggcgttgagcagtcggtcatcgccagtaaaccgtgatggtgaatacgtgccagcagcgtttcaacaggcaccggacgcgggcggtcggtgccgtcaatggcgataatgtccgcgcccgcctgcgccagcgcatcaacatcttcaatataggccgtgatgcgtaccggagaatcctccagatcgcgtttcacaattccaataatcggcacgctcaccaccgcacgcgtggcttgcagatttgccacaccttcaatgcgaatggcaaccgcgcccgcctgttctgccgctaatgccatggcggcgacgatttcgggtttatcgagcgggctgtccggaaccggctggcaggagacaatcaggccaccgttagcagcgattttttgatccagttgtgcaagtaacgacatacatcttcccttagcgaaaggcccggtacatagaccgggcaacaggattaacttttggttttgactaaatcgtttttggcgctgccaaacggcacggcaccgctgaatggtttaccgtcgatagcgtcatgagtacgcaacgcttccgggcgcaaccaacgctgaacgcgagaaggcatatccagcccaatcagcaggatcaccacgaacgtcagactgaacgagagcgatgccagcgcagtacccagatccagacgttgagcgatcaacgcgccgatgattggggccagtgcaccgcccaatgcgccaacgttgtaggtaaagcccaggcccgctgcacgctggtcggtatcgaaataaccgccaatcagttttggtaagatcccggcgatcccttgtccaagcatttgctggaagaacagtaacagaccgagcacccagacgtttgcgccgccaatcgcaaataccggaataatcagcagctgcgaggccagcaggctacaaacgtacgctttgcgggttcccagccagtcaccgaggaagccacctacgcagcatcccaccgccgcgccaaagccactaaagaacagcacattggctacagtatgcgggttataagccagatcggttttcagatacgttggcagcagcgcctgaatcggccatgagtagaggaaagcaaacaacacgaccaccatcagcattacgcccgttggccagcgtttgcctgcactctgcaccataaagctgataaagattgcggcgcataacagcccaagaacagcgacgatcgcggcattttgcaggttaccggcgaagcagaaccacagcgcagtagccgccgccagtgtcattacgatattggcaatgcgatgttcaccacggtagagaatatccaccattgtgcgtactggtgctttacctgcgtgtttctctttccagtcttccgcttccgggatgtttttacgcagccagagagcaaagatgattggcaaaatgccgataaagaacagcgcacgccagccccagaccggaaccaccaggctatagacctgagcggcaacgacggcccccacagagaagcctgaaatcaaaaaaccactggctttgttacgcagatgttttggccagctttcaatgacataggtggcgctggaaccgtattcacccgccatccccatgccgatgaccagacgagcgataaacatggtgatgtagcctggcgcaaagccgcaggccagcgtcccggccgagaagagaacgatgctggtgaccattgccagacgacgcccgtagcggtcacccatagcgccgagcatcaggccgccgaaccagcgagagataaaggctgcagagatcagacttgccgcctgcaccgtcgtcagcccgaattcaccttgtacttcggtgagtaccagggcgattaaaacgaaatcaaaaccgtcaagcagatatcccaaccaggcagcggaaaatgcgcgccattgtgcacggttgagatggcgataccacgggatattctgggttgtagtactcattgtgagtctcccgcggtgggcgatgcccacacgctttggtatgaaaattgtagggtacagatgcgtttatttcccctcacccggtaggggcgagcgaggggaaacaactcacccgcgctcttgcatcaactgctgggccagcgccttcagttctggcagatatttttcatctaccggtccaaacggtttgcggcacagcggcacagaaacgacatccatataatggaggacagttttcaggccgcggaatacgcccgttttgatcagtaaatcaatgactttattgcattcagtttgcagtttctgcgcggtctggatatcgccttctttcagcgccttaacgatcccctgatagcgccagcccatgatgttgtaggtactgccgataccaccatcagcgcccgccagcagaccagaggcgaagatttcgtcgtaaccgttatagagcacaagatcaggatgttcacgacggatctgctccatctgatagagatcgccagaggtctgtttcagcgcacctacgccaggcaatgtaacaagtgtgttgatctgatccagggtcagttttaccccactcagggctggaatgttgtacaccaccatcggcaaaccatccgccgaatcaataattgcccgatagtgatcgcagtgttcttcaaagctgaaaggatagtagaacggcgtgacggcggagacggcatcgaagccataacgtttagccgatgccgcaagttgttggctttcggcggtgctgacgcaaccgacgtgggcgatgagtttaatcttacctttcgcctcttcggcgacgatttccagtacctgttcacgctcggaaaggctttgtacaaaggcctcgccggtcgaaccacccacgtataaaccgtcgatgccctgctgaatattgaactgaaccaggcgacgcagactcgctttatccagtgcttgttgttggtcaaaaggagtcaggagtgcagccattacgccacgtaaattcgttgccataaatacctctgaagtgatgcttgtctgataaacgatatacctttatacctgttataccagatcaattaagcaacaccccatacagaaagcttataatgcgatctgcttcactaaagtggcattatttctttttgttggtggtctgaccgaaagcgtgccaggtagcagagacgctgttgagatgcgattgcaacgcacgatcggcttcgtcaggatcatgacggcggatcgcatcaacgatcgcaatatgctgttgataactaacgttgttatgttcgtgcagtgcctgatcggtaaccgttgggcgtgcggcaataagccagtcgagcagggcaacgtggatcgccatgaagattgggttaccggggatctccgccagcacgcggtggaaatcaacgtctgaacgaatgaatgccgcgttgttatccagcgactgactgttgatttccagtgcttttgccagcaaatcgatttgctcatcggtggcatgttcagccgcatagcgcaccagactggattcaaagaacagacgtaattgttcgaaatgggcaatcccaccgggatgagaaaggaaatctttcgccatgccggaaagctcaccgatgatagtgtccgcagaaggacgcgagacgcgagcgcgttcgccgttgtttatttgcaccagacctttgcgttttaacgctgccagcgcttcacgcaccgaaggacgcccgacgttaaagaacgccatcagttcgcgttcagacggtaattgttcaccttcgccaaattcacgacggcggatcatctgttccagctcttcttccaccatttcggagagttttttacgcgccagcgggcggctacgcaagttgcgaccaattgcaggtgaagaatcttcggtttgcgaatcaaatgcgttcataaggcccattctgtaaggtcagtgtgattaacatcatcagtgacatcctatcacaggattgaaagtaggggaaaatggcagggttttctctttgtgcctcatcattaccataattaacggaataattaactattgcgaaaaattaatgtaacgcagataaaaacatcccgtttgaattatttataagactattcacgagcattatgaatattatgaatgtgttcttacaaaataatcataagcgcatattttttaatgaaaaatcacctcacctacaattaaaaacacgacatccgcaccataaatagccttgcaaaaaatataacatcgttgttttcaatctgccgtttatgggattgaccgttttcttttgacacggagttcaacaatgttcggcataattatatctgtcatcgtattaattacgatgggctatttgatcctgaaaaactacaaacctcaggtggtgctggctgccgcaggtatcttcctgatgatgtgcggtgtctggttagggttcggtggtgtactcgatcccaccaaaagcagcggctacttgatcgtcgatatttataatgaaatcctgcgcatgctgtccaaccgcattgccggattggggctgtcgattatggcggtgggcggttatgcccgctacatggagcgcataggggccagtcgcgcgatggtgagcttgttaagccgcccgttaaaactcattcgctcgccgtatattattctgtcggcaacttacgtcatcggccaaatcatggcgcagtttattaccagcgcctccggtctgggtatgttgctgatggtcaccttatttccgacgctggtgagtctgggagtaagtcgtctctctgcggtggcagttatcgcaaccacgatgtccattgagtgggggattctggaaacgaactccatttttgctgcccaggtagcgggaatgaaaattgccacatacttcttccactaccagcttccggtcgcctcttgcgtcattatctcggtggcgatctcccactttttcgtgcaacgcgcttttgacaaaaaagataaaaatatcaatcacgaacaggcagagcaaaaagctctcgataatgtcccgccgctctattacgccattttacctgtgatgccgttaatcctgatgctcggctcgctgttcctcgcccacgtcgggctgatgcagtcagaactgcatctggtggtggtgatgttactgagtttgactgtgacgatgtttgttgagttcttccgcaagcataacttgcgcgaaacaatggacgatgtgcaggcgttttttgacggcatgggtacgcagtttgccaacgtggtaacgctggtggtcgcgggtgaaatatttgcgaaaggcttaacgacgattggcactgtcgatgcggttatcaggggggcggagcattctggtctgggcggtattggcgtgatgattattatggcgctggtcattgccatttgtgccattgtgatgggctctggcaatgcgccgtttatgtcatttgccagtcttattccgaatatcgcagccggactacatgtaccagcggttgtaatgattatgccgatgcattttgccacgacgctagcgcgcgcggtttcgccgattactgcggtggtggtcgttacgtcaggaattgcaggcgtttcgccttttgcggtggtgaagcggacagcgatccccatggcagtcggtttcgtggtgaatatgattgccacaatcacgctattttattaagtcattaaaaagacaaaacaggccgcctgggcctgttttgtattacttcacaacgcgtaatgccggtcgaccaccgcgtggtggctgcggaggttcatcgtcaggatgagtgtcatcatcgtgatctggcttgtcgccatcaataaccgacataacggtttcgttgtctgccgatgcctcttcatcattcatgatgctggtatcttcatcgtaggcagcttcaggctcaaacatcgtgcctgcgccattttcacgggcgtagatagccagcacggcagccagcggcacagaaacctgacgcggaatgccaccaaagcgcgcgttaaagcgcacctcatcattcgccagttccagattgccgacagcacgcggcgcaatgttgagtacgatttgcccgtcacgcgcatattccataggaacctgcacgccagggagcgtcacatccaccaccaggtgcggcgtgagctggttatccagcaaccactcatagaatgcacgcagcagatagggacgacgtggtgttagctgtgacaaatccatacagattaactccggcccagacgcatttcacgttctgcttcagttaaagaagcaaggaaagagtcacgctcaaagacgcgggtcatatagcctttcagctctttcgcacccgggccgctgaactcgatgcccagttgcggcagacgccacagcagcggagcaagatagcaatcgaccaggctgaactcatcgctcaggaagtacggcttctgaccgaagaccggcgcaatcgccagcagttcttcgcgcagttgcttacgtgcggcatctgcttcagaagctgaaccgttgatgatggtgttcatcagcgtgtaccagtctttttcgatgcgatgcatgtacagacggctttcaccgcgagctaccgggtaaacaggcatcagtggcggatgcgggaaacgctcatccagatattccataatgatgcgagattcccacagggtcagctcacgatccaccagggtcggaacgctctgattcgggttgaggtcaatcagatcctgaggcggattgtccttttccacgtgttcgatctcgaaacttacacctttctcagccagcacaatgcggacctgatggctatagatgtcagtaggaccggaaaacagcgtcattaccgaacgtttgttggcagcgacagccatgaaaacctccaggtatagtcagaatttttactgctaccagccaccaggtggccagtcagaagttgtgttacccaataaggaacgactctctttgttcgaaaatcaaacaaaaaatgagcaatacccgacatttgggcagaaaattggatgatagtttaccagattttgcgaccattgtggtgagtcgatgccggaaatggggaaaaagagatgcgctttagtctgaaatagttgacttagtcccttattggcgatgtggtttttgttttacctgtctgtcaggtggcagcaaaaagcaactttccagtttttacgctgattcagattttagctataaaaaaacccgccgaagcgggttttttcgaaaattgttttctgccggagcagaagccaattaacgtttggagaactgcggacgacgacgtgctttacgcagaccgactttcttacgttcaacctgacgagcgtcacgagtaacgaagccagctttacgcagttcagaacgcagggactcgtcgtattccatcagagcgcgggtgataccgtgacggatcgcaccagcctgaccagagataccaccacctttaacggtgatgtacaggtccagtttctcaaccatgtcgaccagttccagcggctgacgaactaccatgcgggcagtttcacgaccgaagtactgttccagagaacgttggttgattacgattttaccgttgcccggtttgatgaaaacgcgagctgcggaacttttgcggcgaccagtgccgtagtattgattttcagccattgcctataatcccgattagatgtcaagaacttgcggttgctgtgccgcgtggttgtgctcgttacccgcgtaaactttcagtttacggaacatagcacgacccagcgggccttttggcaacatgcctttaaccgcgatttcaatcacacgctcaggacggcgagcaatcatctcttcaaaggtcgcttgtttgataccaccgatgtggccggtgtggtgatagtacactttgtcagtacgcttgttgccggttacagcaactttgtcagcgttcagaacgatgatgtaatcaccggtatctacgtgcggagtgtattccgctttgtgcttaccgcgcaggcgacgagccagttcagtagccagacggcccagagttttaccggtcgcgtcaacaacataccagtcgcgttttacggtttctggtttagctgtaaaagttttcattaaaagcttacccaataaatagttacacgttggtgaacacccaaacgtcttcaattgttgaggttcacacgacaaagtccggcaaacctaccccttcgaatagcctatgccagcacacaaaaagttttgggaaaaaaactttcttgtaacgtggggtcgcaggattatagagaagtcggggtcaaagatcgacccctttttgtgatttgtgacaggttttaacccgccaaatgctcgcgcttcagatactcttcgctttgcatctcttgcagacgtgacaggcaacgctggaactcaaacttcagccgatcgccctgataaatttcatacagcggcacttctgcactcaccactaatttgacatggcgctcgtaaaactcatccaccagcgcaataaagcgccgcgcttcgctctccatcaaccgcgtcataactggtacatcaaacaacatgaccgtatgaaagagacgtgagagcgcaatatagtcatgctgactgcgggcgtcgacgcacagcgtagtaaaagagaccgccagcgtctggttctcgacgcccattgttgctaatggccgatggttgatttctaacgtcggtgaattttctcgtttcccccccgccagcgccaaccatagtttatccatttgcgcccgggtttcatcgtgaagtggcgaaagccacagatgcgcctgagtgagtgtacgcagacgataatcaacaccagcgtccacgttcattacatcacaatgctgtttaatggcatcgattgcaggcagaaaacgcgcacgttgcaggccatttcgataaagttcatccggcggaatatttgacgtcgctaccagggtaataccgcgagcgaacagggctttcatcagaccgccaagtagcatggcatcggtaatatcagaaacaaaaaattcgtcaaaacagagcacgtcagtttcggctttaaagcgatcggcaataatttccagcggatcggtctgcccctgtaaggcagttagctcttcatgcacccgcagcataaaacggtgaaagtgcaggcgctgtttccgctctcccggcaggctttgatagaaaaggtccatcagccaggttttcccgcgtcctacaccgccccacatatataagccacgcactggcgtatgctttgtgtcttcgcgtttaccccacagcttaccgacccgcgccattagcccactcgtcctgggggctggtggcgtgctattgatgagttcctgataaataatttccaggcggctgacggcctctttttgaacgtcgtcgggttgatggctgccttcattaagcgccttcaggtattgcgatgttggggtaacgctttgcatgatcttattgttattccttgaataatcggtgcgccgttgttcacggttgacgaaaaaaaggccgttctacactacgcgatatgcagtcgggattccacttctgtggaattaacggttatagtggcataatcagccgcaggcatggagcctgaagccaacaccctacggaaacaaaagacaacgggagatgttcatgacctgggaatatgcgctaattgggttagtcgtcggcatcattattggtgctgtggccatgcgttttggtaatcgtaaactacgccagcaacaggcgttgcagtacgaactggaaaagaataaagctgaactggacgagtatcgcgaagagctggttagccactttgcccgcagcgcggaattactggataccatggcgcacgactatcgccagctgtatcagcacatggcaaaaagctccagcagcctgctgccggaactgtctgctgaagcaaacccgttccgtaatcgtctggcagagtctgaagccagcaacgatcaggcaccggtgcagatgcctcgcgactattctgaaggcgcatccggcctgctgcgtactggcgcgaagcgcgactaatttatttttcgggcgcagccattgcgccctcctcttctctccctccccgactatcatttaatctggtgtctcattgttagccgtctgaaaattcaataacatcaaactgttttgaatctcttttcttatcattcaggtacgagagcaggaataatgaaaaaacaaacccagctgttgagtgcattagcgttaagtgtcgggttaactctctcggcgtcatttcaggccgtcgcgtcgattccaggccaggttgccgatcaggcccctctccccagtctggctccaatgctggaaaaagtgcttccggcagtggtgagcgtacgggtggaaggaacggccagtcagggacagaaaatcccggaagaattcaaaaagttttttggtgatgatttaccggatcaacctgcacaacccttcgaaggtttaggctccggtgtcatcatcaacgccagtaaaggctatgtgctgaccaacaaccatgtgattaatcaggcacagaaaatcagtattcagctcaatgatgggcgcgagtttgatgcaaaactgattggtagcgatgaccagagcgatatcgccctgttacaaattcaaaacccgagcaaattaacgcaaatcgctattgccgactccgataaattgcgcgtcggtgattttgccgtagcggtcggtaacccatttggccttgggcaaaccgccacctctggcattgtttccgcattaggccgcagcgggttgaatcttgaaggtctggaaaactttatccagacagatgcttccattaaccgcggtaactccggcggtgcactattaaaccttaacggtgagttaattggcatcaacactgcaatccttgcgcctggcggcgggagcgtcgggattggatttgccatccccagtaatatggcgcgaacactggcgcagcagcttatcgactttggtgaaatcaaacgcggtttgttaggcatcaaaggcaccgagatgagtgccgatatcgccaaagccttcaaccttgacgtgcagcgtggcgcgtttgtcagcgaagtgttgccaggttctggctcggcaaaagcgggcgtcaaagcgggcgatattattaccagcctcaacggcaaaccgctgaatagctttgctgagttgcgctctcgtatcgcgaccaccgagccgggcacgaaagtgaagcttggcctgctgcgtaacggcaaaccactggaagtagaagtgacgctcgataccagcacctcttcgtcggccagcgctgaaatgatcacgccagcgctggaaggtgcaacgttgagcgatggtcagctaaaagatggcggcaaaggtattaaaatcgatgaagttgtcaaaggaagcccagctgctcaggctggcttgcaaaaagacgatgtgatcattggcgtcaaccgcgatcgggtgaactcgattgctgaaatgcgtaaagtgctggcggcaaaaccggccatcatcgccctgcaaattgtacgcggcaatgaaagcatctatctgctgatgcgttaatgtcgtaaaccgggcatcaggcttacgtgtgatgtccggttaactcgtggtatgctgctgccgttcccttttttaatgacgcctccatcatgtttgtgaagctcttacgttccgttgcgattggattaattgtcggcgctattctgctggttgccatgccttcgctgcgcagccttaacccgctttccactccgcaatttgacagtaccgatgagacgcctgccagctataatctggcggttcgccgcgccgcgccagcggtggttaacgtttacaaccgtggtttgaacaccaactctcacaaccagcttgagatccgcaccctgggatccggtgtaatcatggatcaacgcggttatatcatcaccaataaacacgtcatcaacgacgccgatcagatcatcgtcgccttacaggatggacgtgtatttgaagcattgctggtgggatctgactctctaaccgatctggcggtacttaaaattaatgccactggcggtttacctaccattccaattaatgcacgtcgcgtaccgcacattggcgacgtagtactggcgatcggtaacccgtacaacctcgggcagaccattacccaggggattattagtgccacgggtcgaatcggtctgaacccgaccgggcggcaaaacttcctccaaaccgatgcttccattaaccacggtaactctggcggcgcgctggtgaactcgctgggcgaactgatgggcattaatacgctgtcgtttgataagagtaacgatggcgaaacgccggaaggtatcggctttgcgattcctttccagttagcaaccaaaattatggataagctgatccgcgatggtcgcgtgatccgcggctacattggtatcggcggacgtgagatcgcaccactgcacgcgcagggcggtggtatagatcaactgcaagggatcgtggttaatgaagtgtcacctgacggcccggcggcgaatgcgggtattcaggtcaacgatctgattatttcggtggataacaaaccggccatctctgctctggagacgatggatcaggtggcggaaattcgccctggttcggtgatccctgtagtagtgatgcgtgatgataagcagttaacgctgcaggtcaccattcaggaatatccggcaaccaattaagtcgtgcgctcaaaacaaaaaaccggagtctgtgctccggttttttattatccgctaatcaattacttattaacgaactcttcgcccagggcgatatctttcttcagcgtatccagcataccttccagcgcgttctgttcaaatgcgctcagggtaccgatagatttacgctcttccacgccgtttttacccagcagcagcggttgagagaagaaacgggcgtactgaccgtcgccttcaacgtaggcacattcgacaacgccttgttcgccctgcagtgcacgaaccagagacagaccaaaacgtgcagctgcctggcccatagacagggttgcagacccgccaccggccttcgcttcaaccacttcagtacccgcgttctggatgcgtttggtcagatcagccacttcctgctcggtaaaactaacgccaggaacctgtgacagcagcggcagaatggtaacaccagagtgaccgccaataaccggcacttcaacttcgcctggctgtttgcctttcagttccgcaacaaaggtgttggaacgaatgatatccagcgtggtaacgccgaacagtttgtttttgtcataaacaccggcttttttcagcacttcagcagcaattgcaactgtggtgttaaccgggttagtgataataccaatgcacgctttcgggcaggttttcgcaacttgctgtaccaggtttttcacgatgccggcgttaacgttaaacaggtcggaacgatccatacccggtttacgcgctacgcctgcagagataagaacgacatctgcgccttccagcgccggagtcgcatcttcaccagaaaaacctttgattttcacagcagtagggatatggctcagatcgacagccacaccgggagtcactggagcgatatcatacagagagagttctgaacctgaaggcagttgggtttttaacagtagtgcaagcgcctggccaataccgccagcagcgccgaggactgcgactttcatcctaaactccttattatattgataaactaagatatgttgctccgctgccgcgaccttaatccacaaaattgccgtttacaatgaccacatctcaagaatgtgtagtcacgcaagtttagcgtttatgcatttaattgccgtaatcaggaacctaacttacgtaattaacagtcgcttatgcattagcgcaacattccaacaggtggtgacaatataccctaccgttcagccaaaacaacatcaatttgataacaattaatttacttttaagcagaatttgcatgccgtgacgcaggcatgtttctcaataacgaaatttgataaaatcccgctctttcataacattatttcagccttcttcagggctgactgtttgcataaaaattcatctgtatgcacaataatgttgtatcaaccaccatatcgggtgacttatgcgaagctcggctaagcaagaagaactagttaaagcatttaaagcattacttaaagaagagaaatttagctcccagggcgaaatcgtcgccgcgttgcaggagcaaggctttgacaatattaatcagtctaaagtctcgcggatgttgaccaagtttggtgctgtacgtacacgcaatgccaaaatggaaatggtttactgcctgccagctgaactgggtgtaccaaccacctccagtccattgaagaatctggtgctggatatcgactacaacgatgcagttgtcgtgattcataccagccctggcgcggcgcagttaattgctcgcctgctggactcactgggcaaagcagaaggtattctgggcaccatcgctggcgatgacaccatctttaccacccctgctaacggtttcacagtcaaagacctgtacgaagcgattttagagctgttcgaccaggagctttaatctctgccccgtcgtttctgacggcggggaaaatgttgcttatccctctcaaccccctgctttcccctgcgattaatttaacgaatagtgcgttttactgcgacatgtcattcacacaatgaatacataaggtaaaaaaagcacattatgcaaaattcattatctaattgaaaaaactagaattaacgataaataaccgtatttttaattcttttttgttattaaaattcacatttttaacacttagtatcaactgaaacagttagcgcggtattaattagctcaataattagtgtatacttgattttgtgatatgggtcacgaaacaaaggcccagctaaaagattatgtcgaggtaaaaatcatgaaaatcaaaaccactgttgctgcattaagcgtactttctgttctctctttcggtgcattcgctgccgactccattgatgctgcacaagcacaaaatcgtgaagcaatcgggaccgtatccgtaagtggtgtggcgtcttcgccaatggatatgcgtgaaatgctgaacaaaaaagcggaagagaaaggcgcaacggcctaccagattactgaagctcgtagcggtgacacctggcacgctacggctgaactgtacaaataaaccctcatcgtcttgtccgacgatattgcccccggttcgggggcttttttttgcgctaatgacgaacattaaaacgcaaatgcccttccagctcttcctctgcctcatcaaacagcaatattaacgcgccaaaacggcgacgcgttttctctcccagatgaacaaattcaatctcaagtggtagcggcaggacatcgttcattaacacatcccatagtgagtcgagatcgcgtaccttatctttcgccagaccaaaggtttggctaaagtcacgataaaaatcctcctgactctcaatctcatcaaaatcaaaggtataaatattcatctgttgccaccgtcacgtttcgcggcgagttctgccgtgcatcgctaagtatagccatgaaaaaaccgacgcttttggcgtcggttttgacttaactatcggtcaacgcatgttgatacttatggagcatccccgccagccgatttaccggttccgtcacctgcggtggcgcttgccagatgcgtagcttttcctggtagatttccagttcttccagcaactggccaaagtaccgacgacgtttatcatcgctacgggcagatatcacatggtctgctgtgcggcgcatttgtcggtgaaacgccgataaatcctcgttaaccgggatcggtgcatcacgcaggcgctggtgcgcgataatcatcgtcagcgccaggcgaaatttcggcaaatcccctgggaacttattcatcagcaaaaacagctgctgataaagtgccgggaggtggttctctttacgacgtgccacattggtagtcatcgcggaaacagcggcagaaacaaactgattaagcagtacacgtccggtcctgtcgcgcgatttatcccgcaccagcaaaataacggtgaacgcgagcacacagccgacgatttgccctaatgcgctgtcgagaaactgactgaaatggaaagtcatcgggttatccagcacgataatatttatggtgctggccagtgcccccatcgagcccagtcgccgtttctgtacttctataccgaggaagaatcccagcactgccaggctaatgcacagcagcaacatgctctgttgggtattagggataatcaccaaaaagtagagcagccctaacggcagcgcggccagcgtcccgtagataaagtcgatcgccaccatgcgtggattcggcaaacgcattgccagtgacgtcactaccgcaatcatcaccattgcaccactgccggaagtccagcccgtccacagccagaaaagcgtgcccagaatgcaggaaagtgtggttcgccagaagttaaccattgcatgatgacgttcggctgactctacttttacttccggttcgccttgcaggatctcttcttcggtggcgttgatttttgtgttactgataacgccgcgcttgagaagctgataacgcgttgccgccgcgacccagctataaatggtgacaggcgtttcccgttccccggtccaggcgataactctccgcaggcgtttgagctgcttgtggacgtcctgcgcggtttctaccggcgtgtcaaaaaattcgcggaaagtatcagtgatcaattccgggcgcgtattctgaataagataagtttcgcaggattgggtaatcagcgtcagcgatagcgtattgatcgcttttaaacgtcgattggcccgcgcccagcgggaagattccatattcaggttgctgcgcatgccttgtagcgccgtggtgcgtcgcaccaggtcgccccaggctttatcgacaacttcaccatcgccatgcttgatacagagttgcattaattgatattgcgcgaccagcaaactttccagctctcgatccacttcttgtttgatcgatcgcggagaaaagagcaaatccgccataatcgcacacacaataccgataacgatctcgctacaacgttcgacggcaaactgcggcgtaagcaatggttccggctgaatggtgatcacaatgatcagcgcggtataaccggccagcccccacgcatacgagttttctattcgtaccagcgaggatatccaggtacaaaaaccggcccagatacagcacaccagaatcatcaataatggtgcgcggatcatcgcaatgatgatcaccagtccggcaatacagccaataaatgtgccgatgatgcgcaaaaagccacgatagcgaatagcgccagaatacggttcacctcccgcagcaaaggccgtaccggcggcaacaatcgccgctgtcagtaccgcccagcgtggcgtttccagctggaagtgaaagccaacaaacagcgccagtacaatggcggtcgccagttttaccgcaaagcgaatatgttggttagcaatggagaaaatacccatcgtgattaaccaaactcacgcaggcgatgggccattttacggaagaacgaatcctggctttcgtcgcgatcttgtttgccagtgaccaccactgtagcagtggtgcccgcaggccagatgttctcttgctggttgtcgagacgaatacgaaccggaacacgttgcgcaagacgcacccattcaaggttagagtctatagtcgccatccctttgtcgtcacgcgtgctgctggcgttggtgacccctgcggcaacactatcaacagtccctttcagcactttgttactgccaagcggcgtgatctctgcacgataccccggacgcaccccttccagcttagtttcttccatataggccagtacatagaaggagttctgtttcaccagcgcaaccgccgttgatcctcgagtaataaactcaccggtatagacgttgaggttggtcacccagccatctgctggcgcgcggatcaccgtgcgttcaagatccagttttgccagatcgcgggtcgcctgcgctttcgctaactgatgcagaaccgtttgtagtacgttgttggcctggtcgatctcttcgcgagacatcgcctgcacaccgagacggttacgacgtccggcctcctggcgtttctcctgtgccagtacctgataataagcaacatcggcttgcgcttcctcaagcgccttttgatagcgcggctggtcgatggtgaacagtatctgtccttttttcaccagctggttatcatgaacattcacctgggtaatgagtccagaaacgtccggcgcgatcgcaacgacgtcagcgctaaagcgcgcgtcacgcgtccagggggattcggtgtaatagacccaggcattaaaaattgcgatgaaggccagaatgactaatacgaccgtgatggccgtacgggagaattttcttattagtgttttcacttcaacctcaaacgaacagtcgcgatatcaaataaaacaagcagcaatagagcgcggtgttgaacaacgccggatgccagacaaagtcgtagatacctgttggcacaagtacccggcgcaccagccagaaaatcgccagtgataaaagcaattcaaaaaatatcggtgggaaggacagcccaaacaccacgataacgggaaacagactcatgttgaccttggttgtaaagagagagcaggcgttattattttcagcatctgtcgccgcagagaagggcatggaaagccgggcgagagcaacattgctgtagattgatatttaatatattagcgtaactgttatgctgttatctatattatgtgatctaaatcacttttaagtcagagtgaataatggaacgactaaaacgcatgtcggtgtttgccaaagtagttgaatttggctcttttaccgccgccgccagacagctacagatgagcgtttcgtccatcagtcagacggtatcaaaactggaagatgagttgcaggtaaagctgttaaaccgtagcacacgcagcattggcctgaccgaagccggtagaatttactaccagggctgccgtcgtatgcttcatgaagtgcaggatgttcatgagcaactgtatgccttcaataacacccccatcgggacgctacgcattggctgttcttcaactatggcacaaaatgttctcgccgggctgacagccaaaatgctgaaagaatacccaggtttgagcgtcaatctggttaccggaattccagcccccgacctgattgccgacggtctggatgtggtgatccgcgtcggcgcgttgcaggattccagcctgttttcccgccgtctgggcgcgatgccaatggtggtgtgcgccgcgaaaagctatctcacacaatacggcataccggaaaaacccgccgatttgagtagtcattcatggcttgaatacagcgtgcggcccgacaatgaatttgaactgatcgcaccggaagggatctcgactcgcctgatcccacaaggaagatttgtgactaatgatccgatgacgctggtgcgctggctgacggcgggtgccgggatcgcctacgtgccgctgatgtgggtgatcaacgagatcaatcgtggggagctggagatcctgctgccgcgttaccagtcagatccacgcccggtttatgcgttatataccgaaaaagataagctgccgctgaaggtacaggtcgtgatcaactcgctgacggattattttgttgaggtcggtaaattgtttcaggagatgcacgggcgcgggaaagagaagtaattcatattgtactgttacgttgtacaaacctgtgccaacgggttcccctcaccctaaccctcaccccaaaggggcgaggggaccgttcgtgcacgtagaaagattaattatccttctgaaaatagtgaaattattacgcagtaccgccaacagtcaggttatcgactttcaacgttggctggcccacgccaaccggcaaactttgcccttctttaccgcagacacccacgccgttatccagtttcaggtcgttgccaaccatcgaaatctgctgcatggtttcgataccggaaccaatcaacgttgcgcctttcaccggcttcgttactttaccgttttcaatcagatatgcttctgaagtggagaaaacgaatttgccggaggtgatatccacctgaccgccaccaaagttcggtgcatagataccgtactcaacggattcaataatttcctgcggggtcgatttacccggcagcatataggtgttggtcatacgcggcatgggcagatgggcgtaggattcacggcgaccgttgccagtcggcgtcatccccatcaaacgcgcgttgagtttatcctgcatgtagcctttcagaatgccgttctcaatcagcacgttgtactggcctggcgtaccttcgtcatcaatcgccaccgaacctcggcgatcgaccatcgtgccatcatcaaccacggtacacagttctgaagccaccagctccccgacctgtccactaaatactgaagtgccacggcggttgaagtcgccttccagaccgtgaccaaccgcttcatgcaacagcacgcccggccaacctgcgccaagtactaccggcatggtgcccgctggtgcagcaacggcagaaagattgaccagcgccatacgcactgcttcttttgcccatgcatccgcacggacttcgccgtcgagatcggcaaggaagaattcataaccaaaacgaccgccgccgccactggcaccgcgttcgcgtttgccatcttcttcgacgagaacgctcacggaaagacgcaccagcggacggacatccgccgctagcgtgccgtcggtggccgcaaccaaaattaattcatagacaccactgaggctggcagtcacttcctgtacgcgcttgtccgcttcgcgggcaaccttatcgacgcgacgcaggatatccagcttctcttcacggctcatgctttgcagcggatctaccgaggtatacaacgggctatgctctaccgcgcccagcgtctgtactttaccatcaccactatcacggacgatggtgcgcgccgcttgcgcactctgttccagcgccagcaggctgatttggtcagcgtaagcaaatccggttttttcaccgctgattgcacgcacaccaacgccctgatcgatgttgtaagaaccatctttaataatgcggtcttctaaaacccaggattcgtgatagctcgactgaaaatagagatcgccataatcaaggcgacgttcggccagttgaccgaggatcgcgaacaagtcctgatgtttcaggccgttcgccgctagcaattgttcacttaccaggttaagactcatcgtttttgctactcgttagttactgcagtagaggattttttacggctgccggatgcggcgtgaacgccctatccagcctacggttatgttccggtttgtaggcctgataagacgcacagcgtcgcatcaggcaacggctgtcggatgcggcgtaaacgccttatccgacctacggttatgttccgtttgtaggcctgataagacgcacagcgtcgcatcaggcaacggctgccggatgcggcgtaaacgccttatccgacctacggttatgttccgtttgtaggcctgataagacgcacagcgtcgcatcaggcaacggctgccggatgcggcgtgaacgccctatccgacctacggttatgttctggctcgttggcctttggcaacgattatcctatgagattggggcaattacgcgccctcgtcaaatcattgcgctttttctttacgcggttggcgcaacacttcgttgatttgcggatcgtccagcggacccgaaatgtgatagcgcaaaatggagactttgctccacagcggccccagcactttactggcggcaaacactgccgcgccaacaatggggttaaccgcaaaagccgcagccacgcccaccgtcgcagaaatctctggtgcgacaaccgcttccatattcaggtcgcgacgtaccagatttaccgaccctttcatggcgatatccgcctccaggccatccaccagcgtgtcgtcggtgtgcataacgccgtctttaatccacgcggtgctgcgaatggagtcaaaatagaacccttcgccaaaagtgtctctgaaatcaaaacgcagcttacgcatcagggcatctacgctcaataagcgcagcaattgcccggcatgtccggtattgatttcggtaatttcgcctttacccagttgagtatgaatgatgccattcaacgtcgcttcatctggctgccagggtgctttgcgccagtgtaaatcgtaatccacattaaatgacgactggcgtatgggcgtcgtgacaccaaaaaattctgcggcggcatcaattttctgcccgcgcagttttcctttcagcgaggtacgttcattccccggattattaacccattcaccatcggcagtaagccgcgagaaaccagtatcaatcagtccattggtcagcgttaacgtatcgccagaaatggtgatatcactgtcaatgcgaccgaatttttgcccccagaaccagcactctgtgcatcgtatttgggcgtccggccagccacggaagttaatgcgctccgttgtcgggaaaggtgatgacggcgttgaatcaccacgagttttcgccacgctcgggttgtaataaagatatttgatattcgccagccacggcgcgttattacgcatcgctagcgtggcgttgatttcacgcccttgcgcttcaaccagggtgccatttgccgtcggttgcgaaacaatactcaggttattccattgctgatttcccagtgacaacataggcgtacgtaacgttatgtgttgtgggaaactcgctgcaccaccgacactctccgcagcgcctttctggaacagggccagccactcggcaccattcatcggcggcatattgagttcaacgccactttgttccggcaacggcgggagcgttttactgtctgccgcccaaatagcacgatcgagcgtcagcttttgaccgagcaaccagcggctattgaaatgattatccgcaccagcctgtccggttaattcaaagctgttgagattgccatcaaccttaacgtttaccgctagtggttcacccgcaggtttggctaacggtgaaggtaagtgactgctcacattctttagatcgccgttcagctctatgttataggtcgcaccagcatgataaggcagatcaatgcccactttaccatcccacgccacgctgccactcaatgcttcgttcaccgcttcaggcagaacgccggttttcgccggttgccagttaccgttgaggtttaccgctacctggtaggcttttgccccttctttggtggaaaaatccacgttcaacggctgattaaaccagcttgctgtcagtggttcactttgcagatcgctattgataaagctgaatttaccgctcaaatttttcagggtgctgtcgagtggtttgataaacagactgttattacgcagcgtcacttcacctttcgcggttaccagttcgccgttcagcgggatatcaagatgtaagcgagcattcacatcgccgtcgagctggagttcttgcagggtcgcacccagagaatctttcagcggtgtctcatcaaagtaagggccaacggctttacccggacctttaatgtcagcgtcaatcagcagtttttcttttgagtagtcagggatcactgcggtaagattactcgcgcgcacgccgcccagattaacgccatcggttttcatccataaaccgtcgttaataaagtccagttcaatatcaaggttagttaatgcaggccagtccggctggaaggcaaacttcgcgttgcgcagcggcaccagcacttcaaactgaccttcgttgtgtttataggggaagagttgcggattgccaccataaaccagcgtcgcgttatccgcttcaccgccctgaatcgcgccacttaagtaatcaaccaggtctttacccatcaagttttccgggaaatagcgccaggcttgtgaaccatcatcggtactgatgccagccagaatacccagccagggttcatcgttagcaggttgcaggtaacgaaaaccgccgcgcgcatggacggctttggctttaacgtcaatattacgcccatccagctggaaacctttgttattgttcagccagcttatagttgcctggccgtcggcgatttctagtggcgcacggaataccgtttcgtaaggcatctttgcctgcttcatcgacgcggtaagcaaaccattttcaacgctgccggaaagcgtcccggagaagtgttccgcacccggtaataatttccattgcttccaggccagatcgctccacgatgcctgaaaacgggtcttgtctgccgcctgaagcgggatatccagcgccagagtgttaatcttgccgctcggttgtgtggagcgccaaacatcacccagtgcaggtgaaagtttcgcggccagcgggcgtatgccctccaggcctgccagctccagattactggcgcgaatccggagttcgtcactgcgtttattgtctttgccgccaacgtcctgttccggtatccaggccagcgtcaatgctccgctcggccagggtttgccgtccatcgtgatccgtgtatcgggaatagagaactgccagcccggattttcacgcgtaatatgcgcggtcagattatccaccgacagcgtatgcgtttgcttctcgcccaaccagctggcaccgccctgtttcagccagacgtcaccgccggttacatcgcctttgtcgatcgtcatccagccttcaagggagaactgtgccgtttccagcgcaatattgtcctgcatccatttaccgagccacggcttcaggtcgatgtcatccgcctggagccagacgcgaccattgcttaacaacccctcatcatcgcgcaaatccatgcgcacctgcatcacgccgtgctgtccggtaaggctggagaggcttaccaggccttccgcacggtgtcgacgtggatcgttcagccaggtgagttgtgggatcgccagctcggcgcgctgaccggatggcgtcaggaaactgacttcactgtcgcgaagatcgaaatggtcaaattgacgaagaaacagatcgctgatgtgactggcttccagactgtcatcactaccaccgctggtgataggagtgttggtgcgaaagcgcagctgccagaaagtgaggtcgcgaaactgccagcgcatatgtaacaggctctgccagacatccagcgccagagtaacgcgtttaaccgaaaattcgccgccatcttttagttctgcacggatgtcgtgtgcttcaagcgtcgggccaaaattctgccagctggctgagagctgactggcttctaccggcatgccagtcgcggattctattttgttgaggatttccggacgccaggcgtcaagatgcggtaaagcaatacgcaggccgctaaccagcagggcagcgatcacaacgagcgcggctccagtaagcagtaaaatccccggcaatcgcctcacccgtcactccttgtctgctaaaaatgtgactcaaaaaccctttgccggatggcggcccagcatctgtttacatcattacgacgtcaaactgctcctggttatagagcggttcaatttgtactttaacctgtttgccaacgaaaatttccacttccgccagcgagtgtgactcttcgcctttcaaggcttcagctactgccggagaagcatagaccaggaaacggtcggagtcgtaagcatggtggacacgaacaatctcgcgcatgatttcatagcataccgtttccacggttttcaccgttccgcgaccgtggcaggttgggcattcgttacacagtacgtgctcaatgctttcgcgggtgcgtttacgcgtcatctccaccagccccagcgccgaaaaaccattaacgctggttttcacccggtctttgctcaacgcctgctccagcgagtgcagcactcggcggcggtgatcttcattattcatatcgatgaaatcaataatgataatcccgcccagattacgcaaccgtaactggcgagcgatagcctgcgtcgcttcaatattggtattgaaaatggtgtcgtccagattgcgatgaccgacaaacgctccggtattgatgtccacggtggtcatcgcttcggtctggtcgataatgagataaccaccggatttcagttctactttgcgttccagcgctcgctggatttcgttttcgacatcaaagagatcgaaaatcggctggcgtcctgtgtaatgctccagcttgcttgtcatctcgggaatgtactccgaggtgaactcaagtaacgcttcgtaagtcaggcgtgagtcaacgcgaatgcggtccagttcggcatcggcgaaatcacgcagaacacgctgcgccagcgccagttcgccgtacagctgataacgggtctgcgggcgttttttacgctccataactttggtccagacgcgtttcagataagcggcatcggaggccagttcagcctcgccaaccccttccgctgcggtacggatgataaacccgccctgctcgtcgcaatactctgcgaccacttttttcaggcgttcacgttctgattcgctttcaatacgttgggaaaccccaacgtgagaagcccctggcataaacaccagatagcgagaagggagcgtgatatcggtggtcaggcgcgcacctttagtgccaagcggatctttcaccacctgcaccatcagatcttgcccctgacgaaccagttccgagatgtcgcgcaccgtgaattgcttttgttcttcacccgccacacattcggtgtgcggcatgatgtcggatgcatgaagaaacgcggctttatccagcccaatatctacaaaagccgcctgcatacccggaagtacacgacttacacgacccttgtagatattgcctactattccgcgtcgcgcctcacgttcaatatgaatttcctgcagaataccgccatcaatatacgccactcgcgtttccgaaggcgttacgtttactaacaattcagccgtcatgtttatcccttttctcacgcagtgcgttaaaattacttaataattcatacgtttcaaccagcggtaagccgactacggcgtgatagctgccatttatcttcctgacaaaacagccacccagcccctgaataccgtatgcacctgctttatctaacggttcatcgctggcgacatagcccgcgatgtcttcgtctgttaacgttctgaaagtcacatcggtgaccaccaggcaatcgagaatgtgctggctgtcggccaacgccactgctgtcatcacctgatgggtctgacccgataatttgcgcaacatctgcgccgcatgctctgcgtcgcgcggtttctccagcacttctccgttcaggataacgatagtatccgcacccagcaccgggagatccttcgccgtttgcgcgacacctgcccgtgctttctcgcgcgccagacgcacaacatactgctgcgcgctctcctgcggctgacgctgctcctcaatgcccgtaacaatacgttcaaaggtcacgccaagttgcgcaagtaactcctgacgacgcggagaaccggaagctaaatacagagaagtcatagaaacctttattgcactgcaaactgctgacggactttgcgcatcagcaagaaaatccacggccagagcaccccattgactacactactccagaacacttccggtctgaaagagacgttaatcactaaaaactctgcccagaaaacaataatatccaccaccagcgaaagcaacatgacgaccagcgcctgctgccataatgcgaggttgcggaaaagctggtatttcagcgccaccaggtaagcaatgatgctcatcgccaatacgcgtacgccaagcgtcgagccgctgatcagatccagtatggcacccatcacaaaacctgtgcccacatttacgcgatgaggcaaggccaggatccaatacaacaagatgagtaacacccagtttggccggaaaacaatcaggttatccggccagggcatgatttgcagcaacagcgcaatgaggaaagagagccagattacccagcgtccctggctacgatagctcgccactattgccctcccggcgcacgcgcaggcggttgagcaccactttgcggcggcgtagccctttgtggagagcgattagcagcaggctgtgtcggcgcagcaggcgcagtagctgcatttcctgtcgccggttgctgcggagtcggctgagcgatccccgttgccggttcaggtaactttggccccatcgcgtctggcgaaggcaatacctgcggcatcatctgcatcagacgttcattagcaacacgatgcacctcttccggcgtcatcgggttagcgccgttacgatctgccccccacagcagcagcagataacgcaaacgttgcagccctgcagtcggacgcgcctgaatcacagtataagcgcgctgggtatcgagttttacggaagagacaaccgcgaccggatagccttccgggaaacgaccgcccagaccggaagtcaccagcacatcaccaacacgaatatccgtattcgccggcagatgctcaagctgcaaatcatccgtacaaccgttaccggctgcaattacgcggatatcgttgcgcagcacctggattggcagcgcgtgggtcgcatcacaaatcagcagcacgcgactggtcagtttagcgacggccaccacctgaccaacaacacctttgtcgctgatgaccggctggccttcataaacgccattaacgctacctttatcgataacaacttgatcgctataaggatcgttaaccgtggagataacctgagtcaccattttctgctcatcctgacgcagcggggaacccagcagctcgcgcagacgcgcgttctcctgtttgtattgtccaagcatcagcagttcactgtttttcagcaacagttcctgacgtaacgcccggttttcaagttctaattggtcacgcgaggccagcgtctgcgatacgccatccagcaattcacgaggagcattggaaacaaagtagaaaggactgacggcggtatccatataagtacggatttgactgaacgtccccaggcggctgtcggcaataataatgccgagcgccaccagcaccgccagaataaggcgaatctgtagcgacgggccacggctaaaaattggcttcataagttatgcgtattctcgtatcagaccaggcagggtaaacagacacttcccctgcctgcatccgattactcttcgctgaacaggtcgccgccgtgcatgtcgatcatttccagcgctttgccgccaccgcgcgccacacaggtcagcgggtcttcagcaacaacgactggaatgccggtttcttccattaacaaacggtcaaggttacgcagcagtgcgccaccaccggtgagcaccatgccgcgctcggagatgtcggaagccagttccggcgggcactgttccagtgcaaccattaccgcgctcacaataccggtcagcggttcctgcagtgcttcgaggatttcattggagttcagggtaaaaccgcgtggaacaccttctgccaggttacggccacgaacttcgatttcacggacttcatcgcccggataagccgaaccgatttcgtgcttgatacgttctgcggtggcttcaccgatcagagaaccgtaattacgacgcacatagttgatgatagcttcgtcgaaacggtcaccaccaatgcgcacagaagaggagtaaaccacaccgttcaaggagataacagcaacttcagtggtaccaccaccgatatcaaccaccatagaaccggtcgcttcagaaaccggcaggccagcaccaattgcggcagccatcggttcttcaatcaggaagacttcacgggcaccagcgccctgcgcggattcacgaattgcgcggcgttcaacctgggtcgcgccaaccggcacacaaaccagaacgcgcgggcttggacgcataaagctgttgctgtgcacttgtttgatgaagtgctggagcattttttcagtcacgaagaagtcggcgataacgccgtctttcattgggcgaatggcagcaatattgcccggcgtacggcccagcatctgcttcgcgtcatgacctactgcagctacgcttttcggtgaaccggcacgatcctgacgaatggccaccacggaaggctcattcaatacgatgccttgtccttttacataaatgagggtattcgcagtacccaggtcaatggacaagtcattggaaaacatgccacgaaattttttcaacatactaagggataatcctgaaagctggggcggaaaagaaaatccgcttactttaccaaccacacgcagcagcgacaaggcgcaaaaatcatctgctacggtgaaaattagtgcagttcgtttcctttgttacaaatctctgcctgagtccagaaaggcttaatgcatcagcagcattcctcgcctgtttgcaaccgcgtaaggtcattcatctgcatatgtgctgcaacaatctggcgagcagacaagcacactcccatgagacgcagcgcgcattattctacgtgaaaacggattaaacggcaggttaaaccgagtatctttgtgaatattttttcacgttagtatcaagtggctgtgaggacgcgaaaaaatccccttgcccgcctgtaacaccgcgctgaatcagggtctgccactcgcttcgcgaacgcacgccggtggcgtaaacctgggtgctggtcccggagcaggcttccaccaggctttgaaccagcagctggttctccgttcgcttctcaatgtttctgaccagccccggatggagcttgagtaactcaacattaagttctttgatccaactggtacttaccagcgtcaaaccagcctggttgacggctacccgtacccctaaagcattcactaaacgaataacaggttgtaaacgactgatatgttgacctacatcggcctctgcaagttcaataattatgcgttttcgttgtgatttttcacattgcattaacgtatcgcgcagccaacgctgaaaacgcgggcgaatcagcgactcaacggtaacctgaatcgccagattttcctctggccagtaacgcaatagtggaataagacggctgatttgcagacggtcatactcttccgataagccaaactgcaagaccatcggcatatactccgccgagctaacctcttcattaccatcgaagatgcggcacatgagttcgcgatgatgaacctgaccttcgcgagtaaccgccggtttttgataaaggcgcgggccgccgcgactgagcatttgctcgataagcgtacgccagcgaacattaccgcgtcctttttcaggcaacgagtcatcgtaaatagcccagctattgccgccctgcaatcccgcattacgcgtggcagactctgcatgttccattacctgctcggtatcctgaccactacgccaggcgcagataccaatgtggatcatatcgtcgcgatcgagcattttattgttcggcaaggtatcaacggctttgattaactgaccggcgatgctctctgcctcttttaacgtccggtgcggtaacagcgcagcaaaatcactgcggtggtaacgcgccagcagtgcgccagggtagcgcatcataaatgtcgacagcagattcgtcagagtgaagaactgttcttcaacctggctgtgcccccaggtatcgctcaacatattgaaatccggcagacgaatcatcatcacgatcccgtgggtacctactttctcctgatcttccagtaacgttgctaactgattatcgaaaaagagtcggttattgaggccggttttcacgtcctgggcggcataagagcggatcagcgtatcaagacggctgtgttgttcgcgtgcgttctgaatttcacgaagcagcgtatccagcgcactgctggttctgggcggccattcatagatggttcccaacacattagagccacgctcaccgtttaagatacgagtagcccgggtttccagcaattcttgcccggcaagttgccgttgtaaccagcgtaccgccaggaagagcataacaatgataaagccaatcgcccccgtgagcggcgcggtggtcatcaacgaatggaaatagttgcccatcggatcctgataaaccagacgcaacgacatccccggatgctttatcaacggaacgctcagttcgcgaaacagatcgctggagccaactggacgataactaccatttctggccagggtataaacctgtttatcaccatggagcaggtctacacgaacgatatctgccgacatcattaattcggtaatttgtggccttaatacgctgaagtcattcgacacaaggtgggtatcaatcgccgtcgccaccgcctgaacgcgatgactaaacttatactgaatggcgttgtagaaacttagcgaacagcccagcaaagtcacaaaaattgttaacccggtgagcagcgtaacaaaggccgaaaatttcgtcgttaatctcatccttgtgttaactccgatagtgaggaagcgggcatactagcaaatcagatttatctcgcaatttattgcgcttcatcggctttgcttttccattagcgagtatagtcttcagaaattattttccaatccatcatgcacatgaggaccacttatgcaggcgttacttttagaacagcaggacggcaaaactctcgcatcagtacagactctggacgaaagtcgcctgccggagggcgatgtcacggtcgatgttcactggtcgagcctgaactataaagatgcgctggcgattaccggtaagggaaaaatcatccgtaattttccgatgattcctgggatcgattttgccggaactgtacgcaccagcgaagatccgcgttttcatgccggtcaggaggtgttactcactggctggggcgttggtgaaaaccactggggtgggctggcggagcaggcgcgagtgaaaggtgactggctggttgccatgccgcaagggctggacgcgcgtaaagcaatgattatcggtactgccggttttaccgccatgctgtgtgtgatggcgctggaagatgccggtgttcgcccgcaggacggggagattgtcgtgacgggtgccagtggtggcgtcggcagtaccgccgtggcgctgctgcataagttgggttatcaggtcgttgccgtttccggtcgcgaaagtacccatgaatatctgaaaagtttaggtgctagccgtgttctccctcgtgatgagtttgccgaatcccgtcctctggaaaaacaagtctgggctggggcaattgacaccgttggcgacaaagtgctggcaaaagtgctggcgcaaatgaattacggcggctgcgtggcggcctgtggtctggcgggtggttttactctgccaaccacggtcatgccatttattctgcgtaatgtccgtttgcaaggggtggattcagtaatgacgccaccagaacgccgcgcacaagcctggcagcgactggtcgccgatttaccggaatcattctatacccaggcggcaaaagagatatctctgtcagaggcaccgaactttgccgaggccatcattaataaccagatccagggtcgcacgctggtgaaggttaactaaccatttagcagggaataataagagagggaactcattttgaaatcattattcaatcggttaacgggaaaagcggttagccggacagctttcgtcgaacaccttggtcaggaagttatacaacatcatccaaactggaaagtcatgatttcgactgaccacaaattgatgcgcattgatactccactaaacagctattattgatacgcctccgtcgcctgttaggtttatgttgctttgcctgggcgacgctacgcttagccccttacttatttctggtaccatggggtgaataatctgattttgtttgactacaaattaatcactcgaacctatttaatgctgagcattgtcaatcggttaattttgcgtgctttagcattcacatctatccagacgatgcagtgaaaattgggtaatccccagcaaccgctgcgtaatgtcgtctatcttgtcgcgatcctggcatccctacattatttgtggtctgtgaagattatctcattgcagcccctcatcttcgcagggctggcttttcagcttttcaccttacgttataagaagttccgtcgatgatggcgctaatttcgtgaattgtgcggcttgttgcaaattacacggtgttgaaggttatttacatgttagctgttgattatcttccctgataagaccagtatttagctgccaattgctacgaaatcgttataatgtgcgacctcgtcctccctgacgcagtttttgcgctgcggaaaaggtgacattggcgcaacgaaggtatattttgttttttgccggaggatagcagcagatcgctgcacaatgtccgtcaagtctaacattgacactctggggcaaaatagaccggcgtcccggcctgctggaatttatcgctatgcatacagctgtcggggcatacgctttacagacggcggtgaaacgcctgtcacaatcacactaaacaaagagtacggaacccactcatggatattcgtaagattaaaaaactgatcgagctggttgaagaatcaggcatctccgaactggaaatttctgaaggcgaagagtcagtacgcattagccgtgcagctcctgccgcaagtttccctgtgatgcaacaagcttacgctgcaccaatgatgcagcagccagctcaatctaacgcagccgctccggcgaccgttccttccatggaagcgccagcagcagcggaaatcagtggtcacatcgtacgttccccgatggttggtactttctaccgcaccccaagcccggacgcaaaagcgttcatcgaagtgggtcagaaagtcaacgtgggcgataccctgtgcatcgttgaagccatgaaaatgatgaaccagatcgaagcggacaaatccggtaccgtgaaagcaattctggtcgaaagtggacaaccggtagaatttgacgagccgctggtcgtcatcgagtaacgaggcgaacatgctggataaaattgttattgccaaccgcggcgagattgcattgcgtattcttcgtgcctgtaaagaactgggcatcaagactgtcgctgtgcactccagcgcggatcgcgatctaaaacacgtattactggcagatgaaacggtctgtattggccctgctccgtcagtaaaaagttatctgaacatcccggcaatcatcagcgccgctgaaatcaccggcgcagtagcaatccatccgggttacggcttcctctccgagaacgccaactttgccgagcaggttgaacgctccggctttatcttcattggcccgaaagcagaaaccattcgcctgatgggcgacaaagtatccgcaatcgcggcgatgaaaaaagcgggcgtcccttgcgtaccgggttctgacggcccgctgggcgacgatatggataaaaaccgtgccattgctaaacgcattggttatccggtgattatcaaagcctccggcggcggcggcggtcgcggtatgcgcgtagtgcgcggcgacgctgaactggcacaatccatctccatgacccgtgcggaagcgaaagctgctttcagcaacgatatggtttacatggagaaatacctggaaaatcctcgccacgtcgagattcaggtactggctgacggtcagggcaacgctatctatctggcggaacgtgactgctccatgcaacgccgccaccagaaagtggtcgaagaagcgccagcaccgggcattaccccggaactgcgtcgctacatcggcgaacgttgcgctaaagcgtgtgttgatatcggctatcgcggtgcaggtactttcgagttcctgttcgaaaacggcgagttctatttcatcgaaatgaacacccgtattcaggtagaacacccggttacagaaatgatcaccggcgttgacctgatcaaagaacagctgcgtatcgctgccggtcaaccgctgtcgatcaagcaagaagaagttcacgttcgcggccatgcggtggaatgtcgtatcaacgccgaagatccgaacaccttcctgccaagtccgggcaaaatcacccgtttccacgcacctggcggttttggcgtacgttgggagtctcatatctacgcgggctacaccgtaccgccgtactatgactcaatgatcggtaagctgatttgctacggtgaaaaccgtgacgtggcgattgcccgcatgaagaatgcgctgcaggagctgatcatcgacggtatcaaaaccaacgttgatctgcagatccgcatcatgaatgacgagaacttccagcatggtggcactaacatccactatctggagaaaaaactcggtcttcaggaaaaataagactgctaaagcgtcaaaaggccggattttccggccttttttattactggggatcgacaacccccataaggtacaatccccgctttcttcacccatcagggacaaaaaatggacactcgttttgttcaggcccataaagaggcgcgctgggcgctggggctgacccttttgtatctggcagtttggttagtagccgcttacttatctggcgttgcccccggttttaccggctttccgcgctggtttgagatggcctgcatcctgacgccgctgctgtttattggactgtgctgggcgatggtgaaatttatctatcgcgatatcccactggaggatgacgatgcagcttgaagtaattctaccgctggtcgcctatctggtggtggtgttcggtatctcggtttatgcgatgcgtaaacggagcaccggcaccttccttaatgagtatttcctcggcagccgctctatgggcggtattgtgctggcgatgacgctcaccgcgacctatatcagtgccagttcgtttatcggcgggccaggagctgcttataaatacgggctgggctgggtattgctggcgatgattcagcttcctgcagtctggctttcactcggtattctcggcaagaagtttgcgattcttgcgcgccgctacaatgcagtgacgctgaacgatatgctgtttgcccgctaccagagtcgtcttctggtgtggctggcgagtttgagtttgctggttgcgttcgttggtgcgatgaccgtgcagtttatcggcggtgcgcgcctgctggaaaccgcggcgggtattccttatgaaaccgggctgctgatttttggtatcagcattgcgttatataccgcctttggtggctttcgcgccagcgtgctgaacgacaccatgcaagggcttgtgatgctgattggcaccgttgtgctgcttattggcgtagtacatgccgctggcggcttaagtaacgcagtacagaccttgcaaaccatcgatccgcaactggttacgccacaaggcgctgacgatattctgtcgcctgcctttatgacgtcgttctgggtactggtgtgttttggcgtgattggcctgccgcatactgcggtgcgctgtatctcttataaagacagcaaagccgtacatcgggggatcatcatcggtacgattgtggtcgcaattctgatgttcggtatgcacctggccggagcgttaggtcgggcggtgatccccgatctcaccgtaccggacctggtgatcccaacgttaatggtaaaagtgctgccaccgtttgctgccgggatcttcctggctgcaccgatggctgcgatcatgtcgacaattaacgcccaactgctgcaaagttccgctacgatcattaaagatctctatctgaatatccgtccggatcaaatgcaaaacgagacgcgtctgaagcggatgtcggcggtaattacgttagttctcggcgcgttgctgctgcttgccgcctggaagccgccagaaatgatcatctggctgaatttgttggccttcggtgggctggaagccgttttcctgtggccgctggtgctgggtctttactgggaacgcgccaacgccaaaggcgcgctaagtgcgatgatcgttggcggcgtgctgtatgccgtactcgcgacgctgaatattcagtacctgggcttccaccctatcgtgccctcgttactactaagtttgctggctttcctggtcggaaaccgtttcggtacatccgtcccgcaagctaccgttttgactactgataaataaagagttttgccatgccttggatccaactgaaactgaacaccaccggcgcgaacgcggaagatcttagcgatgcgctgatggaagcgggtgccgtttctatcacttttcaggatacccacgatacgccagtatttgaaccgctgccgggcgaaacgcgcctgtggggcgacaccgatgtgattggtctgttcgacgctgaaaccgatatgaacgacgtggtggcgattctggaaaaccatccgctgctcggcgcaggcttcgcgcataaaatcgaacaactagaagataaagactgggagcgcgaatggatggataatttccacccgatgcgctttggtgaacgactgtggatctgccctagctggcgtgatgtgccggacgaaaacgccgtcaacgtgatgttagatccagggctggcgtttggtacgggtacccatccaaccacctctctgtgcctgcaatggctcgacagcctcgatttaaccggtaaaacagtcatcgactttggctgtggttccggcattctggcgatcgcggcgctgaaactgggtgcagcaaaagccattggtattgatatcgatccgcaggcgattcaggccagccgcgataacgccgaacgtaatggcgtttctgaccgtctggaactctacttaccgaaagatcagccagaagaaatgaaagccgacgtggtggtcgctaacatccttgcaggcccattacgtgaactggcaccgttaatcagcgtcctgccggtttcaggcggtttgctgggcctttccggtattctggcaagccaggcagagagcgtttgtgaagcttatgccgatagcttcgcactggacccggtcgtggaaaaagaagagtggtgccgtattaccggtcgtaagaattaaccttcgcatcgccgtagggtgacgcggggcgaagtgcgagcaagctcacaaaaggcacgtaaatttgccgattatttacgcaaatttgcgtgccaaaattttcattcataaagaaaaattgagaacttactcaaatttctttgagtgtaaattttagtcactattttctaatatgatgatttttatgagtaattatcgcaccacgctcattttaaatgcaattctttgatccatctcagaggattggtcaaagtttggcctttcatctcgtgcaaaaaatgcgtaatatacgccgccttgcagtcacagtatggtcatttcttaactcatgcgcatcggacaatatcagctcagaaatcgcctgatcgcagcgcccatggctggcattacagacagaccttttcggacgttgtgctacgagatgggagccggattgacagtatccgagatgatgtcttctaacccacaggtttgggaaagcgacaaatctcgtttacggatggtgcacattgatgaacccggtattcgcaccgtgcaaattgctggtagcgatccgaaagaaatggcagatgcagcacgtattaacgtggaaagcggtgcccagattattgatatcaatatgggttgcccggctaaaaaagtgaatcgcaagctcgcaggttcagccctcttgcagtacccggatgtcgttaaatcgatccttaccgaggtcgtcaatgcagtggacgttcctgttaccctgaagattcgcaccggctgggcaccggaacaccgtaactgcgaagagattgcccaactggctgaagactgtggcattcaggctctgaccattcatggccgtacacgcgcctgtttgttcaatggagaagctgagtacgacagtattcgggcagttaagcagaaagtttccattccggttatcgcgaatggcgacattactgacccgcttaaagccagagctgtgctcgactatacaggggcggatgccctgatgataggccgcgcagctcagggaagaccctggatctttcgggaaatccagcattatctggacactggggagttgctgcccccgctgcctttggcagaggttaagcgcttgctttgcgcgcacgttcgggaactgcatgacttttatggtccggcaaaagggtaccgaattgcacgtaaacacgtttcctggtatctccaggaacacgctccaaatgaccagtttcggcgcacattcaacgccattgaggatgccagcgaacagctggaggcgttggaggcatacttcgaaaattttgcgtaaacagaaataaagagctgacagaactatgttcgaacaacgcgtaaattctgacgtactgaccgtttctaccgttaactctcaggatcaggtaacccaaaaacccctgcgtgactcggttaaacaggcactgaagaactattttgctcaactgaatggtcaggatgtgaatgacctctatgagctggtactggctgaagtagaacagcccctgttggacatggtgatgcaatacacccgtggtaaccagacccgtgctgcgctgatgatgggcatcaaccgtggtacgctgcgtaaaaaattgaaaaaatacggcatgaactaattcaggttagctaaatgcttgattaaaaaggcgctactcggcatggggaagcgccttttttataggtgtcacaaagggagtgaccatgagaacaggatgtgaaccgacccggtttggtaatgaagctaagaccattattcacggtgatgcgcttgccgaacttaaaaagatccccgccgaaagtgtcgatctgatctttgccgacccaccatataacatcggtaaaaattttgatggtctgatcgaagcctggaaagaagatctgtttatcgactggctgtttgaagtgattgcagagtgccaccgcgttctgaaaaagcagggcagcatgtacatcatgaacagtacggaaaacatgccctttatcgatctccagtgccgcaagctttttaccatcaaaagtcgcatcgtctggtcatatgacagttctggagtgcaggcgaaaaaacactacggctccatgtacgaacccatcctgatgatggtgaaagacgcaaagaactacacattcaacggtgatgctattctggtagaagccaaaaccggatcgcagcgcgcgttgatcgattatcgcaaaaatcctccacagccttacaatcatcaaaaagtaccgggtaacgtttgggattttccgcgcgtgcgttatttgatggatgaatatgaaaaccacccgacgcaaaaaccggaagccttactgaaacgcattattctcgcctcttccaacccaggcgatatcgttctcgacccgtttgctggtagctttactaccggtgccgtagccatcgccagcggacgaaaattcattggtattgagatcaacagcgagtacatcaaaatggggcttcgacggctggatgtcgcgtcgcattactctgcggaagaactggcgaaagtgaaaaaaagaaagaccggcaacctgtcaaaacgaagccggttaagcgaagttgaccccgatctcattacaaagtaaaggatgtgtaagcctggttttcagattattcatttcgtgtatatttcctgccagacttggttaaacatgcacaggctcaggtaatgattcgcaagtattggtggctcgtcgttttcgctgtcttcgtttttctgtttgatactttactgatgcagtggattgaactgctggcaacagaaacagacaaatgccgcaatatgaactcagttaatccactaaaactggttaactgtgacgaactgaattttcaggacagaatgtgaatttacatgacacttaattcattcgtttgatgaattaatttcgttatgttttcatctggcatgaacattcttaatacgttatcgaccagagcgggggcttgtttataaagatcataacccgccatattcattaaccagttttgaacaattccgctgaaggcaccatcaataataatcatcacaacatctaaatcgaggttatttgctacacaaccttgttgctgacacgcctgcaatacttcgcggagagtctgcggattaaagcccatcttttcgcgtatcactccctcggccagcatctcatcattaaattcacatttgtgatataagattttcagcaacgcctgctggcggggaattttggcaatatattgcaagccgacaatcaatttttcacgcaattgttgaaacgggtcatgctctaatccagccgtcaagtgttcctggattaactcccgcaatgaaggctgttgcaaccacatctcattaaacagttgagtcttgttttcgaagtgccagtagatagcgccacgcgtaacgttagcggcgtcggcaatgtcgttgagcgtcgtcttgcttacgccatgctgcgcaaactgggcgatggcagtttcaatcagttcttgccgggtcttcagagcttcggctttggttctttttgccatgattaattattcaggaaataaatatattcgacacagagtgagaaaatagcgaaggttaatctatcacctaatgtgtatttatacgagaggctaatattgagttgctataaatcgttaaataaataatatatattatttacctaagatacattcactacatcaatatatatttcaatttacgaggttttaattctgcctctttcaacccgcgtcaaaataaaacagtagaatattaatctttttttgtgtttatgtgccttgagatgcctgtattcataactattccttacatcgacgaatgataatttgtaggatagcgaactgtatttttctttctgcgagttaacgcgttgcctttttgggtaaataacgcgcttttggttttttgaggaatagtaatgacgaaacatgccaggtttttcctcctgccctcctttattctgatctccgcggctttaatcgccggttgtaacgataagggagaagagaaagctcacgtcggtgaaccgcaggttaccgttcatattgtaaaaacggccccgttagaagttaagactgaattaccaggccgcaccaatgcttatcgtatagccgaagttcgcccacaggttagcgggatcgtactgaatcgcaatttcactgaaggcagcgatgtgcaagcaggccagtccctgtaccagatcgatcccgcgacctatcaggcaaattatgacagcgcgaaaggcgaactggcgaaaagtgaagccgccgccgccatcgcgcatttgacggtaaaacgttacgttccgctcgtgggtacgaaatacatcagccagcaggagtacgaccaggccattgctgatgctcgtcaggccgatgccgccgtgattgccgcaaaagccacagtcgaaagcgctcgcatcaatcttgcttataccaaagtcactgcgccaattagcggacgtatcggcaaatcgactgtgaccgaaggcgctcttgtcactaatgggcaaacgactgaactggcgactgtccagcagctcgatcctatctacgttgatgtgacccaatccagcaacgattttatgaggctgaagcaatccgtagagcaaggaaatttgcataaggaaaacgccaccagcaacgtagagttggtcatggaaaacggtcaaacctatcccctgaaaggtacgctgcaattctccgatgtgaccgttgatgaaagcaccggctccataaccctacgtgctgtcttccctaacccgcaacatacgcttttgccgggtatgtttgtgcgtgcacggattgatgaaggcgtccaacctgacgccattcttatcccgcaacaaggcgttagccgcacaccgcgtggtgatgcaaccgtgctgattgttaacgataaaagtcaggttgaagcgcgccctgtcgttgccagtcaggcgattggcgataaatggttgattagtgaaggactgaaatctggcgatcaagtcattgtcagcggcctgcaaaaagcgcgtccgggagagcaggttaaagccactaccgatacccccgcagatactgcatcgaagtaaggtaatctgacatggcaaacttttttattcgacgaccgatatttgcatgggtgctggccattattctgatgatggcgggcgcactggcgatcctacaattgcccgtcgctcagtatccaacaattgcaccgcctgcggtttctgtttcagcaaactatccgggcgctgatgcgcagaccgtgcaggatacggtgacgcaggttatcgaacagaatatgaacggtatcgataacctgatgtatatgtcctccaccagcgattccgccggtagcgtgacaattacccttaccttccagtccgggaccgatcctgatatcgcgcaagtgcaggtgcagaacaaactccagctcgccacgccgttgctgccgcaggaggttcagcagcaggggatcagtgttgaaaagtccagtagcagctatttgatggtggcgggctttgtctctgataacccaggcaccacacaggacgatatctcggactatgtggcctctaacgttaaagatacgcttagccgtctgaatggcgtcggtgacgtacagcttttcggcgcacagtatgcgatgcgtatctggctggatgccgatctgctaaacaaatataaactgacaccggttgatgtgattaaccagttgaaggtacagaacgatcagatcgctgccggacagttgggcggaacgccagcgttaccagggcaacaattgaacgcctcgattattgctcagacgcggtttaaaaatccggaagaattcggcaaagtgaccctgcgcgtaaacagtgacggctcggtggtacgcctgaaagatgtcgcacgggttgaacttggcggtgaaaactataacgttatcgctcgtatcaacggaaaaccggcggcgggcctggggattaagctggcaaccggcgcgaatgctctcgataccgcgaaagccattaaggcaaaactggcggaattacagccattcttcccgcagggaatgaaggttctctacccttatgacaccacgccattcgtccagctttctattcacgaagtggtaaaaacgctgttcgaagccattatgctggtgttcctggtgatgtatctgttcttgcagaatatgcgagcaacgctgatccccaccattgcggtacccgtggtgttgttagggacgtttgccatcctcgccgcttttggttactccatcaacacactaacgatgttcgggatggtgcttgccatcgggctgctcgtcgatgatgcgatagtggtggtggagaacgtcgagcgcgtgatgatggaggataagctcccgccaaaagaagcgacggaaaaatcgatgtcgcaaattcagggcgcactggtgggtatcgcgatggtgctgtcagcggtatttattccgatggcattcttcggcggttctactggggcaatttatcgccagttctctatcaccatcgtttcggcaatggcgctttctgttctggtggcattgattcttacccctgcgttatgtgcaacgctgcttaaacccgtctctgctgagcatcacgaaaataagggcggtttcttcggttggtttaataccaccttcgatcatagcgttaaccactacaccaacagcgtcggcaaaatcctcggatccacaggacgatatttactgatctatgcgctgattgttgcaggaatggtggtgttgtttttacgtcttccgtcttccttcttacctgaagaggatcagggtgtctttctgaccatgattcagttacccgctggcgcgacgcaagagcggacgcaaaaagtgttggatcaagttacggattactatctgaagaacgagaaagcgaacgttgaaagtgtctttacggttaacggctttagcttcagcggccaggcacaaaacgccggtatggccttcgtcagtctgaaaccgtgggaagagcgtaatggtgacgaaaacagtgcggaagcggtaatccatcgtgccaaaatggaattgggcaagatccgcgacggttttgtcattccattcaatatgccagccattgttgaactgggcacggcaacgggtttcgactttgagttaattgatcaggctgggctgggtcacgatgccctaacccaggcccgtaaccagttgcttggtatggcggcgcaacatcctgccagcttagtcagcgtgcgccctaatggcctggaagacaccgcgcagtttaaactggaagttgaccaggaaaaggcgcaggcattaggtgtttcactttctgacatcaatcagaccatttcaacggcgctgggtgggacttacgttaacgacttcatcgaccgtggccgcgtgaaaaagttgtatgttcaggcggatgccaaattccgtatgctgccagaagatgtcgataaactttatgtccgcagcgccaacggcgaaatggtgccattctcggcctttaccacttcacattgggtgtatggctctccgcgactggaacgctacaacggtctgccgtcaatggagattcagggggaagccgcgccaggaaccagttccggcgatgccatggcgttgatggaaaaccttgcgtcaaaattacctgcgggcattggttatgactggacgggtatgtcgtatcaggaacgcttatcgggaaaccaggctcccgctctggtagcaatttcctttgtggttgttttcctgtgccttgctgcactctatgaaagctggtcaattcctgtctcggttatgttggtagtgccgttagggattgtcggcgtgctgctggcggcgacactctttaatcaaaaaaatgacgtctactttatggtgggcttgctaacgacaattggcttgtcggccaaaaacgctattttgatcgttgagttcgctaaagatctcatggagaaagagggtaaaggtgttgttgaagcgacactgatggcagtacgtatgcgtctgcgtcctatcctgatgacctctctcgcctttattctcggcgtattaccgctagctatcagtaacggtgccggcagtggcgcgcagaacgctgtgggtatcggggtaatgggaggaatggtctctgcaacgttgctggcaatcttcttcgtaccggtgttctttgtggtgatccgccgttgctttaaaggataaatcagaaacataaaggcgctttcgggtgcctttattatttccagtgaaacccataaaaattaataagatattcttctgctcactctttaaaagctttctatagttcccgctcccttcactatttttacaattcacataatttgtcattattcattccgcaagatttataacctccggtgataaaatggcattcagctcgttaataagagagttaacttattaagcgttagcgtttattactgaggtaacaccatgaaaagattaattcctgtggcattgctcaccgcattgctggcgggctgtgctcacgattcgccctgcgttccggtttatgacgatcagggtcgtctggttcacaccaatacctgtatgaaaggcacgactcaggataactgggaaacggctggggctattgccggcggggcagctgctgttgctggcctgacgatggggatcatcgctctatcgaaataactgaacagggcgcggagttccgcgctctttttaacgatacagtatctctccataagataaaatattgctatattctgctgggtaattccctgctgatttagcatgttacatcgcgttatttcgctgctttcgaaataacgcatcaatttaattttcacacttcccaccagaaatatactcacgctaacaatcattattctgcttagtaaaacacgcgtaaatattttgcgccaaaatgtggcgcatgtttcattttcgcaccattgcggggcgctgtttttattatttcctgtctacactcagcttattgcgacgcgaaatcgtgcgcaaaagctggcactacttttgcttataagaggatggccacagacaggtaaaagacgtttcccaaacgtcctataacgataattttcgcctcacaggaagcattatgaaaaagatgatgatagccacactggctgccgccagcgtgctgcttgccgttgcaaatcaggcgctgctggcgcgacgcttgatgccgttcagaaaaaaggttttgtgcaatgcgggatcagtgatggattacctgggttctcttatgccgatgctgacggtaagttttcaggtattgatgttgatatttgtcgtggtgttgccgctgctgtatttggtgacgacacgaaagtgaaatataccccgctcactgcaaaagaacgcttcaccgctttacagtcaggggaggtggatttgctctcccgtaatacgacctggacttcatctcgcgatgccgggatgggaatggcatttaccggcgtcacttattacgacggcattggcttcctgacgcacgataaagcggggctaaaaagcgcgaaagaactggatggcgctaccgtctgtattcaggcgggtactgataccgaactcaacgtcgccgactacttcaaggcaaacaatatgaagtacacaccggtgactttcgatcgctctgacgaatcagcgaaggcactggaatctggtcgctgcgatacgctggcctcggatcaatcacaactgtatgccctgcgcatcaaattaagcaacccagctgaatggattgtcttaccggaagttatctcaaaagaaccgcttggtccggtagttcgtcgtggcgatgatgaatggttctcgattgtacgctggacgcttttcgccatgctgaatgctgaagagatgggcatcaattcccagaacgtcgatgaaaaagcggctaatccagcaacgcctgatatggcacatctgctgggtaaagaaggcgattacggcaaggatctgaagctggataataaatgggcctataacatcatcaaacaggtgggtaactactcggaaatttttgagcgtaacgtaggttcagaaagcccgctgaaaattaaacgtgggcaaaataatctctggaataacggcggtattcagtacgcaccgcccgtgcgttaagtcggtgtgaggtaacgagcgtcgctacggcggcgctctcttcagcgttatgctttccgaggtttctatgtctcatcgccgctcaaccgttaaaggctcactctcttttgccaaccctacggttcgcgcctggttattccagatccttgccgttgttgctgttgtcggcattgttggttggttatttcacaacactgtaacgaatctcaataatcgtggcattacttcaggttttgcctttctggatcgcggcgctggcttcggtattgtccagcatttgatcgattaccagcagggcgacacctacggacgcgtttttattgtcggcttactcaatacgctactggtttctgcattgtgtattgtgttcgcttctgttttgggcttctttatcggtctggcgagactttcggataactggctgctacgaaagctttccacaatttatattgagatcttccgtaatattcccccgctgctgcaaatcttcttctggtactttgccgtgttgcgcaatttgcccggaccacgccaggctgtgagcgcgtttgatctggcctttttgagcaatcgtgggctttatattccgtcaccgcagctgggagacggatttattgcgtttatcctggctgttgttatggctatagtcctttctgttgggctattccgctttaataaaacataccagataaagaccggacaactgcgccgcacctggccgatcgccgcagtgttgatcattggtttgcctttactggcgcaatggctttttggcgcagcactacactgggatgtcccagccctacgaggctttaacttccgcggcgggatggttttaattcctgaactggcagccttaacgctggcactttcggtttatacatctgcatttatcgccgagattatccgcgctgggatccaggcagtgccttatggtcaacatgaagcggctcggtcactgggattacccaacccggttacgctacgccaggtcattattccccaggcattgcgggtgattattccaccgttaaccagccagtatctcaacatcgtcaaaaactcctctcttgccgccgctattggctatcccgatatggtttcgctgtttgccggcaccgtgctgaatcagacggggcaagccatcgagacgatagccatgaccatgtcggtctatctgattatcagcctgactatctcgctgctgatgaatatctataaccgccgcatcgcgatcgttgaacgctaaggagtcatgatgacaaaagtattgctgtctcatcccccgcgcccggcgagccataactcaagccgcgcgatggtgtgggtgcgaaaaaatctgttctccagctggagcaatagcctgctgactattggctgcatatggttgatgtgggaactgatcccaccgttgctgaactgggcatttttgcaggctaactgggttggctcaacgcgtgccgactgcacaaaagccggtgcctgttgggtcttcatccacgaacgatttggtcagtttatgtatgggctttacccacacgaccaacgctggcgaattaacctcgcattactgattgggcttgtgtcgatcgcaccaatgttctggaaaatactcccgcatcgcggtcgctatattgcggcctgggcggtgatttacccactgattgtctggtggctgatgtatggcggtttttttgctcttgagcgggttgaaacccggcaatggggcgggctgacgctaactttaattattgcatcagttgggattgcgggggcgctaccgtgggggatcttactggcgttaggtcgccgctcccatatgccgattgtgcgtatcttatcggtcatttttatcgaattctggcgcggcgtgccgctgattaccgttctgtttatgtcttcggtcatgctgccgttgtttatggcagaaggcaccagtatcgacaaattgatccgcgcgctggttggcgtgatcctgtttcagtcagcatatgttgcggaagtcgtgcgaggtggattacaggcgctgcctaaagggcaatatgaagcggcagagtcgctggcgttgggttactggaaaactcaggggctggttattctgccacaggcgttgaagctggtaattcctgggctggtaaataccatcatcgcactcttcaaagataccagcctggtgatcattatcgggttgttcgatcttttcagtagcgttcagcaggcaaccgttgatcccgcctggttgggtatgtcgacggaagggtatgttttcgccgcgctgatctactggatcttctgtttcagcatgtcgcgctatagccagtatctggaaaaacgttttaacaccgggcgtacaccgcattgaggacactatgagccaaattttactgcaacctgctaacgcgatgattacgctggaaaacgtcaataaatggtatggacaattccatgttttgaaaaatataaatttaaccgtgcaaccgggagaacggatcgttctgtgtggcccttcaggttccggtaaatcgacaaccattcgttgtattaatcatctggaagaacatcaacagggacggatcgtggtagatggcatcgaacttaatgaagatatccgcaatattgagcgcgtcaggcaggaagtgggaatggtctttcagcatttcaatctcttccctcatctgaccgttttacagaactgtaccctggcaccgatttgggtacgcaagatgcctaagaaagaggctgaagatctggcggtgcattacctagagcgggtgagaattgccgaacatgcgcataagtttcccggacagatttcaggtggtcagcagcaacgcgttgccattgcgcgttcgctgtgtatgaagccgaaaattatgttgtttgatgagccaacgtcggcgctcgatcctgagatggtgaaagaggtgctggatacgatgattgggctggcgcagtcgggtatgacaatgttgtgtgtaacacatgagatggggtttgcacgaaccgtcgctgaccgggtaatttttatggatcgtggggaaatagtggagcaagctgcacctgatgaattttttgcgcatcctaaatcagagcgtacgagggcatttttatcgcaggtaatccattaattgaatgttagttcgaaaagcaaaaaggccatcctttcggatggcctttcgcttgatttgatgtctggcagtttatggcgggcgtcctgcccgccaccctccgggccgttgcttcgcaacgttcaaatccgctcccggcggatttgtcctactcgggagagtgttcaccgacaaacaacagataaaacaaaaggcccagtcttccgactgagccttttgttttatttgatgtctggcagttccctactctcgcatggggagaccccacactaccatcggcgctacggcgtttcacttctgagttcggcatggggtcaggtgggaccaccgcgctactgccgccagacaaattcttttctaatctgccgaactttaacctaaaaagtggtgctgatacccagagtcgaactggggacctcacccttaccaagggtgcgctctaccaactgagccatatcagcacgctaaatttgatgcctggcagttccctactctcgcatggggagaccccacactaccatcggcgctacggcgtttcacttctgagttcggcatggggtcaggtgggaccaccgcgctacggccgccaggcaaattctgttttatcagaccgcttctgcgttctgatttaatctgtatcaggctgaaaatcttctctcatccgccaaaacagcttcggcgttgtaaggttaagcctcacggttcattagtaccggttagctcaacgcatcgctgcgcttacacacccggcctatcaacgtcgtcgtcttcaacgttccttcaggacccttaaagggtcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagcatcacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggtcaacgttagaacatcaaacattaaagggtggtatttcaaggtcggctccatgcagactggcgtccacacttctaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcttgcgctaaccccatcaattaaccttccggcaccgggcaggcgtcacaccgtatacgtccactttcgtgtttgcacagtgctgtgtttttaataaacagttgcagccagctggtatcttcgactgatttcagctccacgagcaagtcgcttcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcgcaggcttacagaacgctcccctacccaacaacgcataagcgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagtcgggatgacccccttgccgaaacagtgctctacccccggagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctattcggttaaccttgctacagaatataagtcgctgacccattatacaaaaggtacgcagtcacacgcctaagcgtgctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatgtgcatttttgtgtacggggctgtcaccctgtatcgcgcgcctttccagacgcttccactaacacacacactgattcaggctctgggctgctccccgttcgctcgccgctactgggggaatctcggttgatttcttttcctcggggtacttagatgtttcagttcccccggttcgcctcattaacctatggattcagttaatgatagtgtgtcgaaacacactgggtttccccattcggaaatcgccggttataacggttcatatcaccttaccgacgcttatcgcagattagcacgtccttcatcgcctctgactgccagggcatccaccgtgtacgcttagtcgcttaacctcacaacccgaagatgtttcacttcagagttgcgaaaatttgagagactcacgaacaactttcgttgttcagtgtttcaattttcagcttgatccagatttttaaagagcaaaacttcgcagtgaacctttgcaggtacactctgaagtattttttatttaatcactacagagatggtggagctatgcgggatcgaaccgcagacctcctgcgtgcaaagcaggcgctctcccagctgagctatagccccataacatgtagttaaaacctcttcaaatttgccgtgcaaatttggtaggcctgagtggacttgaaccaccgacctcacccttatcaggggtgcgctctaaccacctgagctacaagcctgtagaggttttactgctcattttcatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacggttcccgaaggcacattctcatctctgaaaacttccgtggatgtcaagaccaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacggcgtggactaccagggtatctaatcctgtttgctccccacgctttcgcacctgagcgtcagtcttcgtccagggggccgccttcgccaccggtattcctccagatctctacgcatttcaccgctacacctggaattctacccccctctacgagactcaagcttgccagtatcagatgcagttcccaggttgagcccggggatttcacatctgacttaacaaaccgcctgcgtgcgctttacgcccagtaattccgattaacgcttgcaccctccgtattaccgcggctgctggcacggagttagccggtgcttcttctgcgggtaacgtcaatgagcaaaggtattaactttactcccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttaccccaccaacaagctaatcccatctgggcacatccgatggcaagaggcccgagggtccccctctttggtcttgcgacgttatgcggtattagctaccgtttccagtagttatccccctccatcaggcagtttcccagacattactcacccgtccgccactcgtcagcgaaacagcaagctgtttcctgttaccgttcgacttgcatgtgttaggcctgccgccagcgttcaatctgagccatgatcaaactcttcaatttaaaagtttgatgctcaaagaattaaacttcgtaatgaattacgtgttcactcttgagacttggtattcatttttcgtcttgcgacgttaagaatccgtatcttcgagtgcccacacagattgtctgataaattgttaaagagcagttgcgacgcggctttcagctcactgtcgcgaggtggcgtatattacgctttcctctttcagagtcaaccctgaatttcaggatttttttctcttcgttgttccgaccatcctgtgaagtgtttcacgttgtcgtctcaacggaggcgcattatagggatcccaattttttgcacaagtatttttttgatctttttttctgtttgttgttttttcaccctttttgctgcaatcgcacacaaaacggtgcttttttgcatactaaaagacttgcacaaggccaataatgcccccaaagtcattagtaaatcatttattgctgaggtaagtatgtctgatgttttacgcccataccgcgatctttttccacaaatcggtcagcgcgtaatgatcgacgatagcagtgtcgtgattggtgacgttcgtctggctgatgatgtggggatctggccgctcgttgtgattcgtggagatgtacattatgtacagatcggagcacgcaccaatatccaggatggcagtatgttgcatgtcactcataaatcctcgtacaacccagatggcaacccattaaccattggcgaagatgtcactgttggtcacaaggtgatgctccacggctgcaccattggcaatcgagttttggttgggatgggctcaattttacttgatggcgcaatagtagaagatgatgtgatgattggtgcgggtagtctggtcccacaaaataaacggctggagagcggatatctgtatctcggtagccccgtcaaacagatccgcccgttaagtgatgaagagaaggctgggttacgctattccgcgaataattacgtgaaatggaaggacgaatatctggatcagggtaaccagacccagccttgatcatcttcactttgttcctgaattaagttttccgcttcttcttccaggtcccagcgatgctgacgaaaactcgctaaccactgttctggcgtatctccagtaaagcgatacgccagactctcgccagagatcgcgcatgtcagttgcataccattcacgagagcgggaaaacatacacattttttattctcgtcccactcttccctgtccggaaactggatggcctgattcacgcggacaattcctcctgcaattgctttataactggttctacgtcaggcagaacaccgtgccagagaagaaaggcatgagccgcctgtgccaccagcattcctaaaccatcagcattacgctttgagcctcgctgctcacaccatgccagaaaaggagtttttcctttctgatagaacatgtcatagcaataaatgcctggatgaatgagcgatgacgggatcgccggaatatcaccactgatgccactggatgttgcattaataatgagatcaaactcatgaccttccagttcgtccatactcaacgcctgaatactgccagtgtgcgcaaacaatttagccaactcttccgcgcgggataccgtccgattagttattgtcaccgcacagtccagggaaaggagtggcagtagtacgccgcgagatgctccaccagcgccgataagcagaatacgtaaaccagggcggataaaagacagacgttccagatcgcttaacaagcctacaccatcggtattgtcacccagcaggcgtccatcttctaaccgcatgagggtattaacagcaccagccaacgctgcccgttcagtaagctcatccgctctggcaaaagcctcttctttaaaaggcaccgtcacattcgcacctttaccaccagcactaaagaaagcgttcagtgtgttgatgaaatcattgatgggtgccaacacgcgcccatagggatgttcaatattcagttgctgagcaaattgctgatgaatgaatggcgatttgctgtgggctatcggattaccaaaaacagcataggtttccattatgttacccctgtcgaaacagttcacccgtcagggcatcgcggatttctgaaggatttaaacgcccccccgtttcaccaggcacaaccgggaacgccgcgccaaattgtgcgcgaacttcgtctactgttcgacaaggtggcaatccactcaagttggcactggtagaaaccagcggtttaccataagcctggcacaaagcaaccaccaacggatggtcggtgactcgtacagcaagcgaatcaaagcggcccgtcaaccagcgcggtgttgtcgcaggcgcgggaaagacaaaggtgacaggacctggccagcgggaaaaaatggtttcacgctgcacgtcagtcaacatggtgtcatcaatatagggtttaagctgctcgtaatttgctgcgattaaaatcagccccttatcaaccggacgctgttttaactccaacagtcgcatcactgctgtttcgctatcaggatcgcacccaacaccgaaaacggcttccgttggataggcgatgacacgttcttcattgagaacatctatcgcagctgcgatagcgtctctttgcaggttattattcacgttattattccgccgaaaccggctttccacattgtttactggcacaaaagtgttttacaccctgcgcggttttcttttcgatgagtagcggataatgacactcagggcattctccagctatgggtttgaagttaatggcaaattgacactccgggtagcgatcacaagagtgaaatgttttgccataacgggagcggcgctggaccagatggcccgtccgacattgggggcatgtaattgctgtttcgtccggtttatcgataagttcggtatgttcgcattcagggtagttaatgcaaccaataaacataccaaagcgtccctggcgtaataccagatttgcgccacatgcagggcaaacctgcccctccagaactttgacgatatgtccatccgctgaagatttcagaggacggacgtagtcacacgccggatactgtgagcatccaagaaacggaccgtgtttcccggatcgaataaccagttcagccccgcactttgggcaggactcattattacgcaccgtgaacagtgctgatttcgccataacaacttatgctgaattaaagaaatgattaatgcagcataccttcattcacttcaaagagtaattcttccatttgctggtacgcattttcgcagcccggaatattgaacaacaccatcaggatcacccatttcagatcatccagttcgaactctgcgttatccagcgcgagcactcgctctatcaccatttcacgagtttcaaggttgagcacctgaatctgctcaaggaaaagcagaaacccacggcagctggcatccagtcgttcacactcttccggtgtataaatacgcatggagagaggatccgaggccagttgcatcggttctgccaacccttcctgataatcagcaagtttttccagccatagcagggcattgtagatatcttctcgctcaaaacctgcgtcggtaagatcctgttcaagtttgtcttgatccacacgcaactcagcttctgtgtgaatataggtttcaaacaaatacattagtacgtcgaacatggcatgccctcctcaatcggacatagccgccgggtacagctgcgatccatcctgctaactccagttcgagtagttgagtaactacctctggcacaggttggccggcacgttcagcgacgacgtcaacaggtgttacctcatctcctacgttagccaggagctcaggaaatggcaatgccacgtcttgctgatctggtgaataaaatgaattttcaggggcgtctggcaaccagtgcaatccaaattgcaagttttccagaatttcttccggttccgtcacaagaatcgcaccttgttttattaaccagtgaggcccttcgcttcccggattccctattggacctggcaaggcaaaaacttctcgcccctgctcaagcgcacaacgtgctgtcaccagcgaaccactacgcaaagccgcttccaccaccagtacacctttacttagaccactgataatgcgatttcttcgtgggaaattgtaagcaaggggtggaacatcgaggggaaattccgagacgagagcgcccccctgttcaagcagactggcagccagtcgggcatgacggcggggatgaatggtattaagtccattccccaatacagcaatgctgacgccatttacctgtaaggctgctttatgcgctacaccatcgattccacgcgccagtccactcgtaattgtcactccacgcgtcgccagagtttcgcaaaataatcgtccccatcgctcgccataccatgaatgcgcccgactccccactacggcaagctgaaatgaatgcagcgcgtgcagttctccttcaacaaacagtgcgccggggtaatctgtcgtcgccagaagttgaggaggataaaattcgctgtccgcaggaattaaatgatggttgggttgctccaaccaacaaagtgagctttcgatactctttcgtggaaatgaaagaaagcgttgtgcctgccgcaatgtaagccctgtttgctgcaatacaaccgcatcaatatgcgactgttttgccacccagtgagcgatacggaccatatcatcgccgtacaagctgctgatactcattaaacgcagccaaatttctgtatcgaccatccttatctccctgccataagcagccttagcaatctttgcgattggtcagtgatgctgtcaatcagagggggatttgtctagaatagaagaaataatctttctaactcctgaacacatctctggagatttatgtcagttttgcaagtgttacatattccggacgagcggcttcgcaaagttgctaaaccggtagaagaagtgaatgcagaaattcagcgtatcgtcgatgatatgttcgagacgatgtacgcagaagaaggtattggcctggcggcaacccaggttgatatccatcaacgtatcattgttattgatgtttcggaaaaccgtgacgaacggctagtgttaatcaatccagagcttttagaaaaaagcggcgaaacaggcattgaagaaggttgcctgtcgatccctgaacaacgtgctttagtgccgcgcgcagagaaagttaaaattcgcgcccttgaccgcgacggtaaaccatttgaactggaagcagacggtctgttagccatctgtattcagcatgagatggatcacctggtcggcaaactgtttatggattatctgtcaccgctgaaacaacaacgtattcgtcagaaagttgaaaaactggatcgtctgaaagcccgggcttaaggataagaactaacgtgtcagaatcactacgtattatttttgcgggtacacctgactttgcagcgcgtcatctcgacgcgctgttgtcttctggtcataacgtcgttggcgtgttcacccagccagaccgaccggcaggacgcggtaaaaaactgatgcccagcccggttaaagttctggctgaggaaaaaggtctgcccgtttttcaacctgtttccctgcgtccacaagaaaaccagcaactggtcgccgaactgcaggctgatgttatggtcgtcgtcgcctatggtttaattctgccgaaagcagtgctggagatgccgcgtcttggctgtatcaacgttcatggttcactgctgccacgctggcgcggtgctgcaccaatccaacgctcactatgggcgggtgatgcagaaactggtgtgaccattatgcaaatggatgtcggtttagacaccggtgatatgctctataagctctcctgcccgattactgcagaagataccagtggtacgctgtacgacaagctggcagagcttggcccacaagggcttatcaccacgttgaaacaactggcagacggcacggcgaaaccagaagttcaggacgaaactcttgtcacttacgccgagaagttgagtaaagaagaagcgcgtattgactggtcactttcggcagcacagcttgaacgctgcattcgcgctttcaatccatggccaatgagctggctggaaattgaaggacagccggttaaagtctggaaagcatcggtcattgatacggcaaccaacgctgcaccaggaacgatccttgaagccaacaaacaaggcattcaggttgcgactggtgatggcatcctgaacctgctctcgttacaacctgcgggtaagaaagcgatgagcgcgcaagacctcctgaactctcgtcgggaatggtttgttccgggcaaccgtctggtctgatagtccactcttctaagcccggtcttgccgggcgtttttatacttatgaaaaaacaacgtaatttacgtagcatggcggcccaggccgttgaacaagtcgtcgagcaagggcaatcattaagcaacattctgccaccgctccagcaaaaagtttccgataaagacaaagcacttcttcaagagttgtgctttggcgtactgcgtacgctttcgcagttagactggctgattaataagttaatggcccgtccgatgaccggcaaacagcggaccgtgcattacctgattatggttggtttgtatcaactgctttatacccgcattccacctcatgctgcgctggctgaaacggttgaaggcgctatcgcaattaagcgtccgcaacttaaagggttgataaacggtgtattacgccagttccagcgtcagcaagaagagttattagccgagtttaatgccagtgatgcacgttatctgcatccttcctggttgctgaagcgtctgcaaaaagcgtatccagagcagtggcaatccatcgtcgaagccaataaccagcgtccgccaatgtggctgcgtattaatcgtacgcatcattcccgcgacagctggcttgcattgctggatgaagcaggaatgaaaggtttcccgcatgcggattaccctgatgctgtacgtctggaaacacctgcacctgttcatgcgctacctggttttgaagacggatgggttaccgttcaggatgcatcagcacaaggttgcatgacctggcttgcgccacaaaacggtgaacacattttggatctttgtgccgcccccggcggtaaaacaacgcatatccttgaggtggcaccagaagcgcaggttgttgcggttgatatcgacgaacagcgcctctctcgggtttacgacaatttaaaacgccttggtatgaaggcgaccgtgaaacaaggtgatggccgttacccttctcaatggtgtggcgagcaacagtttgatcgcattttattagatgcgccttgttcagcaaccggtgtgattcgtcgccatccagatattaaatggttacgtcgcgatcgcgatatcccggaactcgcgcaattgcagtctgaaattctcgacgccatttggccgcatttaaaaaccggtggaactctggtctatgccacctgttcggtgttaccggaagagaatagcctgcagattaaagcctttttgcaacgtaccgctgatgccgaactttgcgaaacaggaacaccagagcaaccgggtaaacaaaatctacctggtgccgaagagggcgacggcttcttttacgctaagctaatcaaaaagtgatgagataacgggtcgcgactgatgaaaattatcattctgggtgccggccaggttggcggcacactggcggaaaacctggttggcgagaacaacgatattactgttgtcgataccaacggtgagcgtctgcggaccttacaggataaatttgacctgcgggtcgtgcaggggcatggctctcatccacgcgtattgcgggaggcaggtgccgacgacgccgatatgctggttgctgtaaccagttcagatgaaaccaatatggttgcctgccaggtagcctactcacttttcaacacccctaatcgcatcgctcgtatccgctcaccagactacgtgcgcgatgccgataagctatttcattcagatgctgtgccgattgatcatctgatcgcaccagagcagttggttatcgataatatttaccgactgattgagtatcccggcgcattgcaggtggtgaacttcgctgagggtaaagtcagcctggctgtggttaaagcctattatggcggcccgctgattggtaatgcactttcgaccatgcgcgaacatatgccacatatcgatactcgtgtggcagcaattttccgccacgatcgccccattcgtccgcaaggttcgaccattgttgaagctggtgatgaagtgttctttattgccgcttcacagcatatccgcgcggtgatgagtgaattacagcgactggaaaaaccgtataagcggatcatgctggttggtggcggtaatatcggtgcagggctggcgcgtcgtctggaaaaagattacagcgttaaactcatcgaacgtaatcagcagcgcgctgccgaactggcggaaaagttacagaatacgatcgtcttttttggtgatgcgtcggatcaagaactactggccgaagaacatatcgatcaagttgatctgtttattgccgtcaccaacgatgacgaggccaatatcatgtccgccatgcttgccaaacgtatgggtgcgaaaaaggtgatggtattgatccagcgtcgcgcttatgtggatctggttcaggggagcgttatcgatattgcgatttcaccacaacaagcaactatttctgcgttgcttagccatgtgcgaaaagcagatattgttggtgtttcctcattgcgccgcggcgtagcagaagctattgaagccgttgctcacggtgatgaaagcacctcacgcgttgtcggcagagtcattgacgaaatcaagctaccgccaggaacgattattggagcggtggtacgtggaaacgacgtgatgattgccaatgacaatctgcgcattgagcaaggcgatcacgtaattatgttcctcacagataaaaagtttattaccgacgtcgaaagactcttccagccaagccctttcttcttgtaattaataaggcgtctaatgacgccttattatttccctttgattatcaaggattaattaaattcattcctggcaggaaaatggcttaacatttgttagacttatggttgtcggcttcatagggagaataacatgagcattattaaagaatttcgcgaatttgcgatgcgcgggaacgtggtggatttggcggtgggtgtcattatcggtgcggcattcgggaagattgtctcttcactggttgccgatatcatcatgcctcctctgggcttattaattggcgggatcgattttaaacagtttgctgtcacgctacgcgatgcgcagggggatatccctgctgttgtgatgcattacggtgtcttcattcaaaacgtctttgattttctgattgtggcctttgccatctttatggcgattaagctaatcaacaaactgaatcggaaaaaagaagaaccagcagccgcacctgcaccaactaaagaagaagtattactgacagaaattcgtgatttgctgaaagagcagaataaccgctcttaacaagcgcctgaaagcagaagaccagtggtaaaaaagtgatttactttcttgccactggcctcccagttcccccgattgccatgttttccttttcgcatgtaactgcctttccccttcttatttttctctacgcgctgtcggaataagggatcatgtagtaatgcttctatcgcattatcctttatctgccctttagtatgctgatatcgactcataaaaactccagttggttatttaacggcgcgagtgtaatcctgccagtgcaaaaaatcaacaaccactcttaacgccactcgccccttgttcaagagcttcaagaatcgaacaataaacactgctatgagcagtcccacaacaggcatcgttaaggcgttgcaaggaacgctgcatactctgcaactcggctatccgtgcttcgacttcctgcaatctttcctgcacaatgccttttgactcctgacaggtatggtgttcaggatcgatgcggatcgacagcaactcgcggatcgactccagactgaaacctagttgtctggcatggcggataaatttcaatcgctggagatcgctttcggtatataggcgaaacccaccttcagtacgcacttcatgctccatcatctgctgtttttcgtaataacgaatcgtgtcgggtgttacttccgccatttttgccagctcaccaatgcgatacatacatactccactagttatcgttgattttgtccaacaacttgtcagcataatcgccgcgtaaaaaatcggtactcaatccagcttgtcgcagcttcaattccagtaatgacaatcgacggctaacctcttgatattgcggatcatcgtgacggatacctttgagaatatccagaagctgaattgcttctctccgttgctcaagttctggcggtaagcaaccggcattcttcagcaagcgataccccgcacgtaattccggtggcacgtgagaatcatcatccagtatcaatggttcgccgctacctgccaggttatcaaactcacctttcgcttgcgcttctgctatatggcgctctgcccactggtcaagtaaccacataaatactccaggggatgaacaaaaagagtacagctattgtagataagtggggatactacgggtataaaaaaacccgccggggcgggtttttttacgttgcttcagattactctgcagcagcttctgctttctctgaacgatcaaccagctcgatgtaagccatcggcgcgttgtcgcctgcacggaagccacacttcagaatacgagtgtaaccaccggcacggctcgcgaaacgcgggcccagttcgttaaacagttttgccacgatctcgttatcacgagtacgggcgaatgccagacgacgattagcaacgctatcagtcttggcaagagtaatcagcggctcaactacgcggcgcagctctttcgctttaggcagagtcgtcttgatgatttcatgacgaaccagtgaacctgccatattgcggaacatagcctggcgatggctgctgttgcggttcagttgacgaccactcttacgatggcgcatgaccttatccttctcagtaaaaccttaacctgtgatccggttactcgtcagcgatgcttgccggtggccagttttccaggcgcatgcccagagacagtccacgggaagccagcacgtctttaatctcagtaagagattttttaccaaggttaggcgttttaaggagctcaacctcggtacgctgtaccagatcaccgatatagtggatagcttctgctttaaggcagttagcagagcggacagtcaattccagatcgtcaacagggcgcagcaggatcggatcgaactctggtttctcttctttcacttcaggctgacgtacatcacgtaagtcaacgaaagcttccagttgttcagccagaatggttgccgcacgacgaatcgcctcttcaggatcgattgtgccgttggtttccatttcgatgaccagcttgtccaggtcggtacgctgttctacacgcgctgcttcaacattgtaggcaatacgctccacagggctgtagcatgcgtcgaccagcagacggccgattgggcgctcatcttcttccgaatgaattcgggtagaagccggcacataaccacgaccgcgctgaactttgatacgcatgctaatagacgcgttctcatcggtcaggtggcagatcacgtgctgcggcttgacgatttcgacatcaccgtcgtgggtgatatcggctgcagtcacagggccaatgccagatttattcaaggtaagaataacttcatctttgccctgaactctcaccgccagccctttcaggttgagcaggatttccaggatatcttcctgaacgccttctttggtgctgtactcatgtagtacaccatcaatctcaacctcggtcaccgcgcaacccggcatcgatgagagcagaatacggcgcagtgcgttacccagagtatggccaaagccacgctctaaaggctcaagggtcaccttggcgtgcgtcgaactcacttgctcgatatcaaccaggcgcggttttagaaactctgtcacagaaccctgcattgtgtcctctctttggtactaagctttacttggagtaaagctcgacgatcaggtgttcgttaatgtccgcagacagatcagaacgctccggcttacgcttaaacgtaccttccatcttgccagcatcaacttccagccaggttggcttttcacgctgctcagccagctccagagcggctttcacgcgagactgcttcttcgctttctcacgaatgcttacaacgtcattcggactaacctgataagaagcgatgttaacaacacgaccgtttaccataattgctttatggctaaccagctgacgtgcttctgcacgagtggcaccgaagcccatacggtatacaacgttgtccagacgaccttccagcagagccaacaggttttcaccggtgttgcctttcagacgtgctgcttctttgtagtagttacggaactgacgctccagcacaccatagatacggcgaactttttgcttttcacgcaactgcacaccatagtcagacagacgcggtttacgcgcaccgtgctggccaggagcttgttcaattttacacttggtatcgatcgcgcgaacgccagacttaaggaataagtcggtgccctcacgacggctcagcttgagcttaggacccaaatatcttgccattttctttctccaacaaacctggaaaacgaggcgttatacgcgacgttttttcggcggacgacaaccgttatgagggatcggagtcacatcagtaatgttagtgatgcggaaacctgcggcgttcagagcacgaatagtagattcgcggcctggacccggacctttaaccataacttccagattcttgatgccgtattctttcacggcgtcagcgcaacgctctgctgcaacctgagctgcaaacggagtggatttgcgagaaccacggaaaccggaaccaccggctgttgcccaacccaacgcgttaccctgacgatcagtgatagtcacgatggtgttgttgaaagaagcatggatatgagccacgccgtcagagacttgttttcttacacgtttacgtgcacgaattggtgcctttgccattattcaatcaccccgattatttcttgatcggtttgcgcggacccttacgggtacgtgcgttggtcttggtacgctgaccgcgaaccgggagaccacgacgatgacgcaaaccgcgatagcaaccaagatccatcaggcgcttgatgctcatgctgatttcacggcgcagatcaccttcaacgacaaatttggcaacttcgtcacgcagcgtgtcgatttgtccttcagacagctcactgatcttaacatcttcagcgatacccgctgcagccaggatggctttagaacgggtcttgccgacgccataaatcgaagttaatgcgattacggcatgcttatgatcaggaatgttaatgcctgctatacgggccactatgcactcctactatttaatatgtacgttccatgctgaaaagcccgttttcaggatactcaaatggaaacgcacagacatacaaaagattggctggctaatctagccagctcaacccaactttgcaagaaaaatatgcgaaaaaatcagccttggcgctgtttatgcttcggctcggcactgcaaatcacacggatgacaccatcacgcttaacgattttgcagttacggcataatttcttgacggaagcacgaactttcatttttactctccgtaacttctcgggcgaccaattatcggccgtagcctttcaggttcgccttcttcaatgcagactcatactgactggacatcatcagagtttgcacttgagccataaagtccataatcacgacaacaacgataagcagtgaggtcccaccgaagtagaacggtactttcattgcatcacgcatgaactccgggatcaggcagataaaggtaatatacagcgcaccaaccagggtcaggcgggtcattactttatcgatatacttcgccgtttgctctcccggacgaattcctggtacaaatgcaccggacttcttcaggttatctgctgtttcacgcgggttgaaaaccaacgccgtgtagaagaaacagaagaagatgattgcagacgcatagagtaacacataaagcggttgcccaggctgcaaatacagcgaaattgttgtcagccagttccaaccagtaccgcccccgaaccatgacgcgatggtcgccgggaacagaataatactggaagcgaagattgccgggattacccccgccatattcactttcagcggtaaatgtgtgctctgtgcagcatagacacgacgaccttgctgacgtttcgcgtagtttaccacaatgcggcgttgaccacgctcaacaaatacaacaaagaacgtcactgcaaatactaatactgcaaccaacagcaacacgaggaagtgcaggtcgccttgacgcgcttgctcgatagtatgggcaatggctggcgggagtcccgcgacaataccggcgaagataatgattgaaataccgttgccgatacctcgttcagtaatctgttcgcccaaccacatcaggaacatggttcctgtgaccagacttacaacagcggtgaagtagaatgcaaagcccgggttaatcaccaggccttgcataccaggcatattcggcagaccggtagcaataccgatcgactggaatattgccagcaccagagtaccgtagcgggtgtactggctgatcttacgacgaccagactccccttctttcttaatttctgccaacgttgggtgaaccaccgtcagcagctggataatgatcgacgccgaaatatacggcatgatccccagagcaaagatagaagcacggctgagagcaccaccagagaacatgttaaacatctcaatgatggtgcctcgctgttgctcaagcagtttggcaagtacagcggcatcaataccagggatcggaataaaagagccaatacggaacacaatcagcgcaccgataacaaacagcagtctgcgtttcagctcgcctaagccacctttggcactttgaaaatctaatcccggttgtttagccatctgctacttattcctcgattttaccgccagcagcttcgatagcagcacgagcgcctttagtaacacgcaggccacgaacagttaccggagtcgttacttcgccagccaggatcactttcgcgaactcgatctggataccgataatgttagccgctttcagcgtgttcaggtctactacaccgccttctactttagccaggtcagacagacgaatttcggctgtaatcgctgctttacgagaagtgaagccgaatttcggcagacgacggtacagaggcatctgaccaccctcgaaaccgcgacgtacgccaccgccagaacgagacttctgacctttgtgaccacgaccaccggttttaccgaggccagaaccgataccacgacccaggcgtttacccgcctttttggagccttcggccggagacagagtatttaaacgcatctcttactcctcaactttaaccatgaaggaaaccgcgttgatcataccgcgaatagcaggagtatcctcgcgctctacggtgtgaccaatacgacgcagacccaggccaagcagcgttgccttgtgtttcggcagacgaccgattgcactgcgggtttgagtaattttaatagtctttgccatggtttatttccccagaatttcttcaacggatttaccacgcttggcagcgaccatttctggagaattcatattttccaggccatcaatagttgcacgaaccacgttgatcgggttggtggaaccataggctttagccagaacgttatgaaccccagcgacttccagaacggcgcgcattgcaccaccggcgatgataccggtaccttcggaagccggctgcatgaatacgcgagaacccgtgtgaacacctttaacagggtgttgcagagtgccgttattcagcgcgacgttaatcatattgcgacgggctttttccatcgctttctggatcgctgctggaacttcacgcgctttaccgtaaccaaaaccaacgcgaccgttaccatcgccaactacagtcagagctgtgaaggagaaaatacgaccacctttaacggttttagatacgcggtttaccgcgatcagcttttcctgcagttcgccagcttgtttttcgatgtgagccatcttacacctctaccttagaactgaaggccagcttcacgggcagcatctgccagtgcctggacacgaccatgatattggaacccggaacggtcaaaggatacatctttgatgcctttttccagagcgcgttcagcgacagctttacccacagctgcagccgcgtctttgttaccggtgtacttcagttgttcagcgatagctttttctacagtagaagcagctaccagaacttcagaaccgttcggtgcaattacctgtgcgtaaatgtgacgcggggtacgatgtaccaccaggcgagttgcgcccagctcctggagcttgcggcgtgcgcgggtcgcacgacggatacgagcagatttcttatccatagtgttaccttacttcttcttagcctctttggtacgcacgacttcgtcggcgtaacgaacacccttgcctttataaggctcaggacgacggtaggcgcgcagatccgctgcaacctggccgatcacctgcttatcagcgcctttcagcacgatttcagtctgagtcggacattcagcagtgatacccgcaggcagctgatggtcaacaggatgagagaaacccagagacaggttaatcacattgcctttaaccgctgcacggtaacctacaccaaccagctgcagcttcttagtgaagccttcggtaacaccgataaccattgagttcagcagggcacgcgcggtaccagcctgtgcccaaccgtctgcgtaaccatcacgcggaccgaaggtcagggtattatctgcatgtttaacttcaacagcatcgttgagagtacgagtcagctcgccgtttttacctttgatcgtaataacctgaccgttgatttttacgtcaacgccggcaggaacaacgaccggtgctttagcaacacgagacattttttcctccgattaggctacgtagcagataatttcgccaccaagaccagcctggcgcgctgcacgatcagtcataacacctttagaggtagaaacaactgcgatacccagacccgccataactttcggcagctcatctttacgtttatagatgcgcagacctgggcggctgacacgctgaatgctttctacaacagctttgccctggaaatacttcagagtaagttccagttcaggcttggtgtcgccttcaactttaaaatcttcaataaaaccttcttccttcagcacgttggcgattgccactttcagcttggaggaaggcatggtgaccgcagctttgttcgcggcctgaccgttacggatacgggtcagcatatccgcgatcggatcttgcatgctcatctgtctttactcccgtgattcaattggtgacaattaccagctagcctttttcagacccgggatttcaccgcgcatagcggcttcacggaccttaatacggctcaacccgaacttccgcaggaaaccatgcggacgacctgtttgacggcagcggttacgctgacgagacgggctggaatcacgcggcagagtctgcagcttgagaacagcgttccaacgatcttcgtcggaagcgttcacatcagagatgatcgctttcagttcagcgcgtttcgcgaagtatttatcagctaaagctacgcgttttacttcgcgtgctttcattgattgcttagccatttagtaaccctaccttacttgcggaacgggaagtcaaaggcagccagcagagcgcggccttcttcgtcagatttcgcagtagtggtaatggtaatatccaaaccacgaacgcggtcgactttatcgtagtcgatttctgggaagatgatctgctcacggacacccatgctgtagttaccacgaccgtcgaaagacttagcggacaggccacggaagtcacggatacgaggtacagcaatagtgatcaggcgctcaaagaactcccacatgcgttcgccacgcagagttactttacagccgatcggatagccctgacggattttgaagcctgcaacagatttgcgtgctttggtgatcagcggtttttgaccggagattgctgccaggtctgctgctgcgttatccagcagttttttgtcagcgatcgcttcaccaacacccatgttcagggtgatcttctcgacccgagggacttgcatgacagaattgtagttaaactcagtcatgagttttttaactacttcgtctttgtagtaatcatgcagtttcgccatcgtactactccaaattacttgatagtttcgctgttagacttgaagaaacggacttttttaccgtcttcgaatctaaagcctacacggtcagccttgccggttgccgcattgaagattgctacgttggaaacctgaatagcggcttctttttcaacgatgccacccggttggttcagggccggaaccggcttctgatgtttcttaaccaggttgataccttcaacaatgaccttgccggaagacaggacattcttaactttaccgcgtttacctttatctttaccggttaacacgataacttcgtcatcacgacggattttcgctgccatgattcgctccttagagtacttctggtgccagagagataattttcatgaacttctcactacgaagctcacgagttaccggcccaaaaatacgcgtaccgataggctgctcgctgttgttgttcagaagaacacaagcattaccatcgaagcgaatgacagaaccgtccgggcgacgaacacccttcttggtgcgcaccactaccgccttcagcacatcaccttttttgaccttaccacgcggaattgcttctttgatggtgatcttgatgatgtcgcctacgcctgcgtagcgacggtgcgagccacccagaaccttgatacacattacgcgacgtgcaccggagttgtcggcgacgttcagcatagtctgttcttggatcattttagtgctccgctaatgtcaactactactgagacccgaaaatcaggtcgttaaaaatccccatatcgagggcgcggcattataacaccgcttcaaggatatgggtagaaaaaataaacggctcatttctgagccgtttattcgtattgagagagtgtactgtattacagaaccgctttctctacaacgcgaaccagcgtccaggatttagtcttggacagcggacggcattcgcggatttcaaccacgtcaccgataccgcattcgttgttctcgtcatgtacgtgcagtttggtcgtacgcttgatgaatttaccgtagatcgggtgtttcacaaaacgttcgatagcaacaacaatggatttctccattttgtcgctaacaacgcgaccttgcagagtacggattttatcggtcattacgcacccgccttctcgttcagtaaagtcttaacgcgtgcgacatcgcgacgcacttgcttcaacaggtgagactgttgcagctggccacttgcagcctgcatacgcaggttgaactgctcacgcagcaggttcagcagctcggtgttcagctcttcaacgctcttctcacgcagctcttttgctttcattacatcaccgtcttagttacaaaggtggttttaatcggcagtttcgctgctgccagcttgaatgcttcacgggccagctcttccggaacaccgtccatttcatacaggactttacccggctgaatcaaggcaacccaatactccacgttacctttacctttacccatacgcactgccagcggcttttcagtgatcggtttgtccgggaacacacggatccagatcttaccttgacgcttaactgcacgggtcatagcacgacgtgctgcttcgatctgacgggcagtcagacgaccacggccaacagctttcagaccgaagctgccgaagctaacatccgtaccctgcgccagaccgcggttacggcctttgtgcattttacggaattttgtacgctttggttgtaacatcagcgacgctccttatttacggcctttacgctgctgctttttaggctgagcagccggtttttccggttgttcaacagcagccataccacccaggatctcgcctttgaagatccacactttaacgccgattacaccgtaagtggtgtgcgcttcagaggtgttgtagtcgatgtcagcacgcagagtgtgcagcggtacgcgaccttcgcggtaccattcggtacgtgcgatttccgcgccgcccagacggccgctaacttcaactttaatacctttagcgcccagacgcattgcgttctgtacagcacgcttcatagcacgacggaacataacgcgacgttccagctgagaagtgatgctgtcagcaaccagttttgcgtccagttcaggcttacgaacttcggcgatgttgatctgtgcaggaacgccagcgatgtccgctacgaccttacgcagtttttctacgtcttcaccttttttaccgataacgatacccgggcgagcagtgtgaatggttacacggatgctcttagccggacgctcgataacgatacgagatacggacgctttagccagttccttagtcaggtactgacgtactttaaaatcgctgtccaggttgtcagcgaattctttggtgttcgcaaaccaggtagagttccatggttttacaatacccaggcgaataccattaggatgtactttctgacccattgctagtctccagagtctcagcgatcggacacaaccacagtgatgtggctggtgcgcttcaggatgcgatctgcacgaccttttgcacgcggcataatgcgcttcatgctcgggccttcgtctacgaaaattttcgtaactttcagatcgtcaatgtcagcgccatcgttgtgttcagcgttagcaatggcagattccagaactttcttgaccagtacagccgctttcttgttggtgtaggtcaaaatatccagagcctgcgacactttcttaccgcgaatcaggtcagcaacaaggcgaaccttctgagcagaagaacgagcatggcgatgtttagcgatagtttccatctcttcctcctaccttatttcttcttcgcttttttatcagcagcgtggccgcgataagtacgagtcggtgcgaattcacccagtttgtgaccaaccatttcgtcggttacaaataccggaacgtgctgacgaccattatggacagcgatggtcaaaccgatcatgttaggaaagatcgttgaacgacgggaccaagtgcgcaggggcttcttgtctccgctttccaccgctttctctaccttcttcagcaagtgcaggtcaataaaaggacctttcttgagagaacgtggcatggcttatcctctaaaattatttgctacggcgacgtacgatgaatttatcagtacgcttgttgctgcgggtcttcttacctttggtctgaacgccccacggagttaccgggtgcttaccaaagttacgaccttcaccaccaccatgtgggtggtctaccgggttcatcgcggtaccgcgaacggtcggacgaacaccacgccagcgtgcagcacctgctttacccagaacgcgcagcatatgctcagcattgccaacttcgcccagagttgcacggcagtctgcttctactttacgcatttcaccagaacgcagacgcagggtgacataagcaccatcacgagcaacgatctgaacgtaagtaccagcggaacgtgccagctgaccgcctttacctggtttcatttctacgttatgaacagtagaaccaaccgggatgttgcgcatcggcagggtgttacctggtttgattgcagcatcaacgccagactgaatctggtcgccagctttcaggcctttaggggccaggatgtaacggcgttcaccgtctttgtacagaaccagcgcgatgttcgcggaacggttcggatcgtactcaagacgttcaacaactgccgggataccgtctttgttgcgtttgaagtcaacaatacggtaagcctgcttgtggccaccaccgatatgacgagtggtgatacggccattgttgttacgaccaccggatttgctgtttttttccagcaacggagcaaaaggtttgcccttgtgcagctcagggttaaccactttaactacgtggcgacgacccggagatgtcggtttacatttaacaactgccattgtattactcctccgacttactcagcgccgccaacgaagtccagattctggccttctttcagggtgacgtaagcttttttccagtcgctacgacgaccgatacgctgtccgtgacgtttaactttccctttaactaccagggtgttaacgacttcgacttcgacttcaaacagtttctgcacagcagctttgatttctgctttggtcgcgtctttagcaactttgagtacgatggtgttggatttttccatcgcagtagacgctttttcagaaacgtgcggtgcacgcagcaccttcagcagacgttcttcacgaatcatgccagcatctcctcaacttgcttaacagcatcagcagtcattacgactttgtcgaaggcgatcaggctaaccgggtcgataccagttgcatcgcgtacgtcaaccttgtgcaggttgcgcgcagccaggaacaggttttcgtccagctcaccggtgatgatcagcacatcttccagagccatgtctttcagtttctgtgccagcagcttagttttcggcgcttctacagagaacttctcgacaacgatcagacgatcctgacgtaccagttcggacaggatgcttttcagcgcgccgcggtacatcttcttgttaactttttgactgtggtcctgcggacgagcagcaaaggtcacgccaccagaacgccagatcgggctcttgatagaaccagaacgcgcacggccggtgcctttctggcgccacggttttttaccggaaccagttacttcagcacgagtcttctgagcacgagtaccctgacgagcaccagctgcataagcaacaacaacctggtgaaccagcgcttcgttgaaatcacgaccgaaggtagtttcggaaacagtcagcgcgctctgcgcgtctttcaatactaattccattgctatctccttacgccttcacagctggtttaacgatcaggtcgctaccggttgcacccgggacagcacctttaaccagcagcaggttgcgctcagcgtcaacgcgtactacgtcaaggctctgaacggttacacgttcgttacccatctgacctgccattttcttgcctttgaacactttgcccggagtctggttctgaccgatagaacccggaacgcggtgagacaaggagttaccgtgagtagcgtcctgggtacggaagttccagcgcttaacggtacctgcgaaacctttacctttagaggtgccagttacgtcaacttttttaacgtcagcaaacagttcaacgctaatgctctgacctacagtgaactcttcgccttcagccaggcggaattcccacagaccacggccagcttctacgccagctttagcgaagtggccagcttcaggcttggtcacacggttagcttttttagcaccggtggtcacctgaatagcacggtagccatcgttagccaggtctttaacctgagtaacgcggtttgcttcaacttcgattacggttactgggatagaaacgccgtcttctgtgaagatacgggtcatacccacttttttaccgactaaaccaatcattgtttcaacctctcaatcgctcaatgacctgattaacccaggctgatctgcacgtctacaccggcagccagatccagacgcatcagagcatcaacggttttctcggttggctcaacgatgtcaaccagacgcaagtgagtacggatttcgtactgatcgcgcgcgtctttgttgacgtgcggggagatcagaacagtgaagcgctctttgcgtgtcggcagcgggatcggaccacggacctgcgcaccagtgcgcttggcagtctcgacgatttccgcggttgcttgatcgatcagacgatgatcaaacgctttcaggcggatacggattctttggttctgcatgagaccagagctccaattattttataaacgaaaatgattactcctcagacccattacgattgatgggagagtgtaaccgttcttacgtagctccccgattgggagcattgttaggtagccaaattcggctaactgaggttcagattgaacctgctgtcaactacgacaagcccgcgcattatacatacttaaccaccgaacgcaagcgtattgctagtaaagtaaacagccttcgggttatctctcaagttcgttcagtgcatttttgacacgctctcttaaaccggctttctcttcgctttcttccacagtattttcttcgtcttcagaagaagagggggcattctcaaccgcgacgcctgggtcatcttcctcctcgacggattcgacgacggggagtggctgttttttgaagaaatagtgttgtgttgattgtttaaaagcgggcgtttcagcctctacagtgacttcggcttttactatccaaagcacccatagctgcctggcatacccaccaaccagcaccattcctgcaaaccacaggcaaatcagtaataaacaaattacatatattatggtgctgtgtttttgtcgggagaagataccagggtgacctgtttctttctgctcacgcgcggcgatatagaattcaaacatgtcatttccccttcactgttgtttccggggaaatatttgcttcatcccgatataagtaggcactctcccctgccacctgccagagatgtactaacgttgaaaagccaacaacaccgtcagttttcaagtggtggcttttttgaaattgctttattttttctaccaacaagggacgccactccgccgaaggttctgtcgaaatatgcaatgcgcggtttaacatcgtttccagccagagaatctcttcctcgctgctatcacgcgtaatggtactctccccttccggcgacattttccacaacagaagataatcacccgtccataccgactcaaaccatttatgtgtcagcgtccacgtttgctgacctacgaggacatcaacgctagcctcaccgacgcgaacgaccacaacaggcaattttttgtccccgactttaagcgatgcgatccagggcaaattctgatctaccaatgtttgtaaagaagcattcccacttttacatgccagccccgctcttactgcctgatcgcaccaggccgaatcagctgggacctcgtacccccatacgccgtataacacgcttagcgcctcactatcgcgcatcaccacatgagcaatatccttagtcatatcttgtttaactactggcgttacgggtatcagccacgcaggaacgggtaacgtagctgtaaaagaggacagcagtagccaaccacaggtaagagcgataatggttccactcatcaccacggcaagctgcattttccgggggcggttatcacccaatatgcggtaaatcattcgccattgttttgctgtgaaaacgctggtctgctcggcttgctgtaataagcgaattgtttcgccggcaagcgccagctttctgcgatcgccccgacataataaagctatccgtttcagaactctggcggttaaaaggagatcgggttggtcaatattctgaccttcaaggatgcttgccttaagttcgtgctccgtcagacgtcctatcgagacaagttcaatgccctgttttttaaaatcacgttcgacttttcgatcgggtctgccgatcagcaaaaattgaccgtcaggaataagagatattgcgcgttggagatcatcaagtatgcggcggtgattcaggtgagcattttcaataataataagagggcagcgactatcagttcgatgaagcgcatgcagtaattgccccgccatctcatctcgcgtccaggcgctgtcacggcagccctgttcagccgcgttatcgtcggtaacgatccatgcggccttaccttgccaggaaacaacgaggcttaaagtaatcacacggcgatgtttatctttttgcagttgctgcgccagccaggtttttccacttccagcctcacccaacaaatagcatagacgccaggtttgacgtttctcacacaaccaggaaagaataacttctcttctcgtagacatagaacttcctgttttaattattgattatccttaatcataaaaataatgtatgtatttattaattaaatacatattactaatataaataaattttgcttgattcatgcaagcggcattaatactatttatactaacgtcaatatacaacccacccaatctattttattagaacatacatcgtgcccacactacgtttccccttccatctggcgaatcataataaagatgctgccatcaatatattgattatatttataagcatagggtcgattatttttaatgtgaattatttccatacaactatagttaaaaatggacagatcattaatcaaccaacaaacgcatttcagtctgatttcagccttgccgctttatggcgtaacgaaaatcatgctggggtaaaagatgcaaatcccgtggcagttaatcaggaaacacctaagctctctatagcgcttaatggcattgtactcacatcgaatgatgagacttcttttgtcttaattaatgaggggagcgaacaaaagcgatactccctcaacgaagcccttgagtcagcgccgggaacgtttattagaaaaataaataaaaccagcgttgtgtttgaaactcacgggcattacgaaaaagtaactctccatccagggctacctgacatcatcaagcagcctgattcagaaagtcaaaatgtactcgctgattatattatcgccacgcctatacgtgatggagaacagatatacgggcttcgattgaaccctcgtaagggcctcaatgcatttaccaccagcttgctacaaccaggggatatcgccctcaggatcaataatctttcgctgacccaccctgatgaggtttcacaggcattaagtttactgctaactcaacaaagtgctcagtttacaattcgtcgcaacggcgtaccccgcttgataaatgtttccgtcggggaacttacaggaatgaatggactgcgtcatgaaaggactcaataaaatcacctgctgcttgctggcagcactactcatgccttgtgcaggacacgctgagaacgaacaatacggcgcgaacttcaataacgccgatatccgccagttcgtggaaatagtgggtcagcatcttggcaaaacgatcctgatcgacccttcggtacagggaaccatttccgtacgcagtaatgatacgtttagccaacaggagtactaccagttctttttaagtattcttgatctttacggttattccgtgatcacgctggacaatggttttctgaaagtggttcgctcagctaatgtaaaaacatcgccagggatgattgctgacagttctcgtccaggcgtaggtgatgagttggtcacccgaattgtaccgcttgagaacgttcctgctcgtgacctggcccccctgctccgccagatgatggatgcgggtagcgtcggtaatgttgtgcattatgaaccctccaacgttcttattctgaccggtcgtgcctccaccattaataaactgattgaagtcataaagcgcgttgatgtcatcggcacagagaagcagcaaattattcatctggaatatgcgtcagcggaagatctcgccgagattcttaatcaattaatcagcgaaagccacggtaaaagccagatgccagccctcctctccgcgaagattgtggcggataagcgaaccaactctcttatcatcagtggaccggaaaaagcacgccagcgcatcacttcattactgaaaagccttgatgtcgaagagagcgaggaaggaaatacccgggtttattacctgaaatatgctaaagccacgaatctggtggaagtgctaaccggtgtttccgaaaagctgaaagatgaaaaagggaatgcgcgtaagccctcctcttctggcgcgatggataacgtcgccattaccgccgatgaacagactaactctctggtcattaccgctgaccagtccgtccaggaaaaactcgccacggtaattgcgcgtctggacattcgccgtgcacaggtgctggttgaggcaatcatcgttgaagttcaggatggaaatggactaaacctcggcgtgcaatgggcgaataaaaacgttggcgcacagcaatttaccaataccggattaccgatttttaacgctgcgcaaggtgtggctgattataaaaagaatggtgggatcaccagcgcgaatcctgcctgggatatgtttagcgcctacaatggcatggccgcaggcttcttcaatggcgactggggagtactgcttaccgcgctggccagtaacaataaaaatgacatcctcgccaccccaagcatcgtaacgctggataataaactcgcgtccttcaacgtggggcaggatgtgccggtgctatccgggtcacagaccacttcaggggataacgtctttaataccgtcgaacgcaaaacggtggggacaaaactcaaagttactccgcaggtcaatgaaggcgacgcggtgttgctcgaaatagagcaggaagtctccagcgttgactcttcctctaactcgacgctcggcccgacgtttaatacccgtactattcaaaacgccgtgctggtcaaaaccggtgaaacggtggtcctgggcggattgctggatgatttttctaaagagcaagtgtcaaaggttcctctgcttggcgatattcctttagtggggcaactcttccgctatacctccaccgagcgcgctaaacgcaacctgatggtatttatccgtccgacgattatccgtgacgatgatgtttatcgctcactgtcaaaagagaaatacacccgttaccgtcaggagcaacaacagcggatcgacgggaaatcaaaagcgctggttggctcggaagatttgccggtgctggatgaaaacacgttcaacagtcacgcccctgcgccatcgtcacggtgaggcattcatatgagaattcactcaccgtaccccgccagttgggcgctggcacaacgaattggttatctctattcagagggcgagattatttatctcgccgatacgccattcgagcggttactcgatattcaacgtcaggttggccagtgccagaccatgaccagcttgtcacaggctgattttgaagctcggctggaagcggtattccatcagaataccggtgagtcgcaacagattgcgcaggatatcgatcaatccgtcgatcttctctcgctttcggaagagatgcccgcaaatgaagatctcctgaatgaagattcagcggcaccggttatccgcttgatcaatgcgattttgagtgaggccatcaaagaaaccgcctctgatatccacattgaaacctatgaaaaaacaatgtcgatccgttttcgcatcgacggcgttttgcggacaattttacagccaaacaaaaaactggcggcactgcttatctcccgaattaaggtcatggctcgtcttgatatcgccgaaaaacgtattccacaggatggaagaattagtttgcgtatcgggcgacgtaacatagatgtccgcgtatccacactgccgtccatctatggtgaacgcgccgtactccgcctgctggataaaaacagcctccagctttcattgaacaacctggggatgacggcagcggataagcaggatttagaaaatctcattcagcttccgcacggtattatcctggtgacagggccgacaggctccggtaaaagcaccacgctctacgccatcctttcggcgctgaatactcccggccgcaatattctgacggtagaagatcccgtggaatatgagctggaaggcattgggcaaacgcaggtgaatacccgtgtggatatgtctttcgctcgcggcctgcgcgccatacttcgccaggacccggatgtcgtcatggtgggggaaattcgtgatacagaaaccgcgcagattgcggttcaggcctcgctcaccggccatctggtactctcaacactccacactaacagtgcatcaggcgcagtgacccggctccgcgacatgggcgtcgaatcattcctgctttcgtcttccctggcagggattatcgcgcaacgtctggttcgtcgcctgtgtccgcaatgccgacaattcacgcccgtatcaccccaacaagcgcagatgtttaaatatcatcagctcgcggtgacaacaattggcactcccgtaggctgccctcattgccatcaatccggctatcaggggcgcatggcgatccacgaaatgatggtggtgacgccggaattacgggccgctattcatgaaaatgtggatgaacaagcactggagcgactagtccggcaacaacacaaggccttaatcaaaaatggcctgcaaaaagtgataagcggtgacacctcctgggatgaggttatgcgcgtcgccagtgccacgctggagagcgaagcatgaattatcgctatcgcgccatgacccaggatggtcaaaaattgcaagggatcattgatgctaacgatgaacgtcaggcacgactgcggctgcgtgaagaagggcttttcctgctggatattcgcccccaaaaaagttcgggagtaaaaacacgtcgcccgaggatcagccatagtgaactgacgcttttcacccggcagttggcaaccttaagcgcagcggcattacccctggaagagagccttgccgtaatcggtcaacaaagcagtaataaacgactgggtgacgtgttaaatcaggtacgcagcgccatccttgaagggcatcccctttccgatgcattacagcattttcccacgcttttcgattcgctctatcgtaccctggtaaaagcgggcgaaaagagcgggctgctggccccggtgttggaaaagctggctgattacaatgaaaaccggcagaaaatccgcagcaagctcattcagtcactgatctacccctgtatgctcactacggtggcgattggggtcgtgattattctcctcactgctgtcgtgcccaaaattaccgaacagttcgtgcatatgaagcagcaactgccgctgagtacacgcattcttttaggtctgagcgacacgttgcaacgtaccggcccgacattattagcgacagtgtttattgtcgctgtaggtttctggctctggttaaaacgcggcaataaccgccaccgttttcatgccatgttgctgcgcgttgcgctcatcggcccgctgatttgcgccattaacagcgcacgctatctccgcactttaagtattttgcaatccagcggcgtccctctgctggatgggatgaatttgtccaccgaaagcctcaacaacctcgaaattcgccagcgtctggcaaatgcggcagagaacgttcgccagggtaacagcattcatctttcgctggaacaaaccgcaattttcccgccgatgatgctctacatggtggcctctggcgaaaaaagcgggcagctcggcacattaatggtcagagccgcagataaccaggagacactccaacaaaatcggatcgccttaacgctctccatcttcgagccagcactcattattacgatggcactgatcgtcctgtttattgtcgtgtcggtactccaacctcttcttcaacttaactcaatgattaattaaggaaagcatatgcgcgcaacggataagcaacgcggttttacattactggaaattatggtggtgatcgtcattatcggcgtacttgccagcctggtggttcctaacctaatgggcaataaagaaaaggcggataagcaaaaagccgtcagcgatattgtggcgctggaaaacgcccttgatatgtacaaactcgacaatcatcactatccaaccacaaatcaggggcttgaatccttagtagaagcgccgacactgccaccgctggccgcaaactataacaaggaaggttatatcaagcgtctgcctgccgatccctggggcaatgattatgtcctcgttaatcctggtgaacatggtgcatacgatctgctttcagcagggcccgatggtgaaatgggaaccgaggacgacatcaccaactggggtttgagcaagaagaaaaagtaagtcagcgatgaatcagcaacgcgggtttaccctgctggagatgatgctggtgctggcgctggtcgctatcacggcaagcgtggtgctcttcacatatggccgggaggatgtcgccagcactcgtgcgcgcgaaacagcggcgcggtttaccgctgcacttgaattagccatcgaccgcgccacgctcagtggtcagcctgtcggtatccatttctctgattcagcatggcgcattatggtaccgggcaaaacaccatcagcctggcgctgggttccattacaagaagatgccgcagacgagagccaaaatgactgggatgaagaactctcaattcatcttcagccatttaaacctgatgacagcaaccagccacaggttgtgattctggccgacggacaaatcacgcccttctctttgttgatggctaacgccgggaccggtgagccgctcctgacgttagtctgttcaggctcatggcccctggatcaaacgctcgccagagatacccgcccatgaacaaacaatcagggatgacactgcttgaagtcttactggcgatgagtattttcaccgctgttgctctgactttaatgagcagtatgcaagggcaacgaaatgccatcgagcgaatgcgtaacgagacgctggcattgtggatagcggataaccagcttcagtcacaagattcattcggcgaggaaaacacgtccagttctggcaaagagttaataaatggcgaagagtggaactggcgcagcgatatccactcaagcaaagacggcacgcttctggaacgcaccataacggtgacattacccagcggtcagacaacctcgcttacgcgttatcaaagcatcgataataaatccgggcaggcacaagatgattaatcgccagcagggtttcacattgctggaggtcatggcggcgctggcgattttctcaatgcttagcgtgctggcgtttatgattttttcgcaagcttccgagttgcatcaacgctcacagaaagaaatccagcagttcaatcagctacagcgcaccatcaccattcttgataacgatctcctgcaactggtcgcccggaggaatcggagtacggacaaaatcatggtgttgggtgaagaagctatttttaccacgcaaagtcgcgatccgctggctcctctcagtgaagcacaaaccttactcactgttcactggtatctgcgaaatcatacgctctaccgtgctgttcgtacttctgtggatggcaggaaggatcaacccgcccaggcgatgctggaacatgtcgagagctttcttctggaaagtaacagcggggaaagccaggaacttcctctctcagtcacgttacatctgcagactcagcaatatggggggttacagcgccgttttgcattacctgagcagttagcgagagaagagtcgccagctcagacgcaggccgggaataataaccatgaataatgaacaacgcggcgtcgcgctgctcattgtactcatgttactggcgctcatggctgctctggcagcagacatgacgctcagttttcacagccagcttcagcgaacccgccaggtaaaccatcatctgcaacggcaatatgatattgaactggcggagaaacttgcgcttgccagcctcacccaggacgttaaagataacgacagacagaccacgttgcagcagtactgggcacagccacaacagttgcagctggaagatggcaatacagtgaagtggcagttacgcgatgcccagcactgttttaatctcaatgcgttagcaaaaatctctgacgacccgctggcttcccctgatttccccgcccaggtattcagtgcgctgctgattaacgccggtatcgatcgcggaaacaccgatgagatcgtgcaatcaatcgctgactatattgatgtcgatgactcaccacgctttcacggcgcagaagatagcttttaccaaagccagacgccgccccggcatagtgccaatcagatgctttttctgactggcgaattacgtcagataaaaggcataaccgaaaacatctatcagcggcttatcccgtatgtctgcgttctcccgaccacggaacttagcatcaatcttaatatgctaacggagaacgatattccgctcttcagagcgttattcctcaataacatcacggatgctgacgctcgggtcttattgcaaaaaaggccgagggaaggctggctaaccacggatgcatttctttactgggcgcagcaggatttctccggtgtgaagccactggttgctcaggtgaaaaggcatctctttccctatagccgctattttacgctgagtacggaaagtatcagcgacgaacaatcccagggatggcaaagccatatttttttcaaccgtaaacagcagagcgcccaaatctatcggcgtacgctgcaactctactaatcataaggatcgtgatgcctgaatcgttgatggtcatacgttcttcctcgacgctgcgtaagcattgggaatggatgacgttctccgcagatagcgtatcttcggtacatacgctcacggacgatcttccgctggagtcgctggccgatcagcccggtgccggaaatgttcatcttttgatcccaccagagggccttttatatcgttccctcacgctgcccaacgccaaatacaaactcaccgcacaaacattacaatggctggcagaggagacgttacccgacaacacccaggactggcactggacggttgtcgataaacaaaacgaaagtgtcgaggtgataggcattcagtcggagaaactcagtcgctatcttgagcgtttacatactgccggactcaacgtgacgcgggttttgccagatggctgctatcttccctgggaagtagatagctggactctggttaaccagcaaacaagctggctcattcgcagtgccgcacatgccttcaacgaactggatgaacactggttacagcatcttgctgcccagtttccgcctgagaatatgctttgttatggtgtagtacctcacggcgttgcagcggccaatccacttatccagcatcctgaaataccatcactgagtttgtattctgccgatattgcattccagcgctatgacatgctgcatggtatttttcgtaaacagaaaactgtaagcaaatcgggaaaatggctcgcccgcctggcagtaagctgtctcgttctcgccattctttcttttgttggcagccggagcatcgcgctctggcatacgcttaagattgaagatcaacttcagcaacaacagcaagaaacctggcaacgttatttcccgcagatcaaacgcacccacaattttcgtttttactttaagcagcaactcgctcagcaatatcctgaagctgtgccgttgctctatcatttacaaacacttctgctggaacaccctgaactgcagttaatggaggcgaactatagccagaagcaaaagtcgctgaccttaaaaatgagtgctaagagtgaagctaatatcgatcgtttctgtgagttaacacagtcctggcttccgatggaaaaaacagaaaaagatccggtcagtggtgtatggacagtaaggaactcagggaaatgattaaatcatggtgggcagaaaaatccacatcggaaaaacagatcgttgcggcactggcggttctctcgctcggcgttttttgttggcttggggtgataaaaccgatagatacctacattgcagagcatcagtcccacgcgcaaaaaattaagaaggacatcaaatggatgcaggatcaagcgagcacccatggtttactcggtcatcctgcgcttacgcagcccatcaaaaatatccttctcgaggaagcaaaacgtgagaatttggctatcacgctggaaaacggcccggacaatactctgacaattcatcctgtcacagctcccctcgaaaacgtctcccgctggctcactacggcacaggtaacatacggtattgttattgaagaccttcagtttactcttgccggaaacgaagagatcaccctcaggcatttgtccttcagggagcaacaataatgacaatgctactgccgctcttcattctggttggttttattgcagattattttgttaatgccatcgcctatcacctctcgccgttggaggataaaacggcgttaacgtttcgccaggtattggttcatttcaggcaaaaaaaatatgcctggcatgatacagtgcccctgatactttgtgttgctgctgctatcgcctgcgccctggcacctttcacgcccatcgtgactggcgcactctttctctatttctgtttcgtactcacgctcagtgttattgattttcgcactcagctcctgcccgacaaactcaccttaccgctgctctggcttggcttggtatttaatgcgcagtatggattaattgatttacatgatgcggtttacggcgcggtagcgggctatggggtgctgtggtgtgtttactggggcgtctggttagtttgtcacaaagagggattgggctacggtgatttcaagctactggccgctgcaggcgcatggtgtggctggcaaacgttgccaatgatactgctgattgcctcgctgggtggcattggttacgccatcgtttcacaacttctgcaacgccggactataaccactatcgcattcggcccgtggcttgcgctcggcagcatgataaacctggggtatctggcctggatctcttattaaccgggagggttctccctcccgacacggctcaaccttcttcgcggatctgtgcttgcagataattttgcaggcccatcttctgaatcagatcaagttccgtttccagccagtcgatatggccttcttcatcacgcaaaatttctatcatcatatcgcggctgacgtaatcatgaacgctatcggcataaccaattgcctcacgcaaattcttcgcgccatccagctcaagtgccagatcagaacgcagcatttcctcaacatcttcaccaatgttcagtttgcccaggtcctgtaagtttggaagaccttccagaaaaagaatgcgctcaatataacgatcggcgtgtttcatctcatcaatggattcatgatactccacatcattgagacgtttgagaccccagtttttaaacattcgggcatggagaaagtactgattgattgcgacaagctcatttcccaacagtttgttgagataatttataactttagtatcacctttcattttttgactccttcgcttccactctttgaagagtagaacggcttacgagtaagtcaaaaaacacactccgtttatgcggactccttaaactccggcagctgcattaattcatcctccatcacttcacgcgcggcccggacacatttaccgcactgattgccgaccggaataaatttttttaattgctggaacgagtgaggggaaaactggcgcacagcctgacgaatttttttatcgctgataccattacaaagacaaacgtacatagagactcccgtatactttcttcaaaaataaatgaaaatagttcttatttcaattacggaaagactcttttttaagcaaagaatagaaatatgaataaaaataatgggctaccaaaagtagcccattgacaaaaaatgcggcgatactggaaggtatcgccaacacatttattgcttagtaaacggcgcgaagatttcgctaaatgcgtacttcggtgcctgttctttagtcaggccgtggaattccggagacaggttagtgccgcccggcaggtcgcgcgcgattgaccagataccaaccataccgagattacgcttctgcgcatcctgcatgaccagacgagcatcagagagatagaacacctcgccctgaacgtcgttcacgccaaccatcggcgtggtacccatcatagcgtcaatttctgcatcgctcttattgggatggaggcctttcaattgtgaatgcaggttggcaatcgcagacgttgcacacttaccgtgaatgttctggccttcggtatttgcagactgacaaatcgcgttaccgtagtccattgtcatcacgttcacacccgccagctcaacacctttcgctttggcatcgctcaggacattcatcccttccggcgtcaggccagtcggcagaattggcaaggtgtaccagatagcaatatctttgccttctgacttccatttatcctgcactttcttcacagcaaggttacgacgttcaatagatgcctgatccgcaacccaggtgccttcgatatcgaagtccaggactttgaggttcaggttatcaacgatgtcataataatgctgcatcagatcgtctacgttcttacaggaagcagccagcggagcgttgttagcaccaccgatagacagcatcacatcgccgccagcctcacgcagagctttgattttgctgtactgagcgtaattctgcataccgtaagcggtaccccatgtcggcagacaggtgttcgcatctttactcaccacaaacgccagcgtgaagtggttgacgttatgattcttagccagcgcagccagatccgggatcgtattcagcgtaaagtcgacatacggtgcataaacgtgtttcggccacgctttcttcggcgtacctacgcgctctttggttccggtccagtcaacaaaaacacgccacgggttgctgtcagaaggagaaactttctgcactttactctgagaaatgtagttcacaccgttaaagcgaatcagcgtatcgctggcataaagcgtttctggattaaactgcggcgcattattcagctcttcgttgctatagctctgagccttacctaacggcttccacgggcggctattgctaccggtggcgttttggttcgccaccagagcagggttgtcactttgcgtccagaacagcgcttcataagcctgcccatcaacaacaacgcgatcacctttcacgtacacagtggatgcggaccatgctttcgccggttcgtatttcttccacgggttatcgccgcccgggacaaagccccatgcgtcttgatcgacagaagttttataatgtgcatcgttataatctacgatgctgtccgcgctgtacgctttgctggcctggaaaccatccgcaacaatgacgccgccgttatcaatttcacaggtagtcgggttaccgtactgactcaattccgcagcggtagctgtacgctcgagacgccatgggttattggagttttcagcgctggtaccccgtgggcaatctttagacccaacccaccaggcgttcttgtaaacattaccattgaaaataacatggtaaatttcgctaccttcctggccgctccacgcttgcaatgagtaatcgttaacgctatccgctggtgttgatggctcgctgttatccggagttggggtcaccggtgtttccggagttggatcaaccggagtcacagcaccgccattattatccggcttaacggaacaggagccagggttaccatactggctgatttctgttgccgttgccgcgcgaacataacgccatgggttactggcatcgttttctttcgcatcgcctgggcaatttgccgcgcctacccaccaggcgttcttataaatgccgccgttatagataacgtaccatgtagaagaaccttcctgacctttccaggctactacagcatagttgtcgtttgacttatcagctggggctggctgaacatcaggagccggtttaacgtccggtgccggtttcacatccggtgaaggctgtggtgctgaagtacaggactgtggattactggtttctgagatttccgttgccgtagcggcacgaacataacgccatgggttgctggcatcattgcttttcgcatcacccggacagttagaagaggctacccaccaggcatttttatataccgcaccattaaagacgacataccaggtctgaccgccctgctgtttattccaggcaactacagaagaattagacggaacagtgccctgtgctggtgtagccgaaccgccattagccggcgtattggatgcaggcgtatttgaatttgaagaagatgagctgccgctcttttcgcaggaaagtgtattgccaaactgactaatttcagcagctgttgcggtacgctttaaacgccacgggttagttgcatcatttgctttcgcttttcccgggcaatttgtagaagaaacccaccaggcattttcataaattttgccatcgaaaataacctgatatttattaccaccttgttggttattccatgcttccattgccaatgctggcagagcggaacacaccagccccataccaatcatagatttagtaaatatatttaatttcattataatcccttgtgacgtaaaaactgcaaaacaaaagtcctacgcaggaattatttacgttttacgagaacccttcaatatgaattaaattacggcattaaaaataagaaaaaagcctgacaaatgaagcattttaaaaacagaaacattcatatttaaaatgttaaattgaattgatattttaaatatgaataatttattcgttctgacagtacgaataagatatgccgtcaacaaatgcaaaaagggcgccgaagcgcccttttcaattcaaaactaattaacgtgtaattagcccagaactttagcaacaacgcccgcgccaacggtacggccgccttcacggattgcgaaacgcagaccgtcgtccatcgcgatcgggtggatcagggtaacaaccattttgatgttgtcgcccggcattaccatctctacgccttccggcagttcgatggtaccagtcacgtcagtagtacggaagtagaactgcggacggtagcctttgaagaacggagtatgacggccgccttcatctttggacagaatgtacacttcagattcgaacttggtgtgcggcttgatggtgcccggcttagccagtacctgaccacgttcgatttcttcacgtttgataccacgcagcagaacacctacgttctcaccagcacggccttcgtccagcagtttgcggaacatttcaacgccagtacaggtagacttctgagtctctttgataccaacgatttcaacttcttcaccaactttgatgataccgcgttctacacgaccggtaacaacggtaccacgaccggagatggagaatacgtcttcgatcggcagcaggaacggcttgtcaatcgcacgctctggttccggaatataagaatccaggaagccagccagttccaggattttcgcttcccactctgcgtcgccttccagcgctttcagagcagaaccacgaacgatcggagtgtcgtcgcccgggaagtcgtactgagacagaagttcacgaacttccatttcaaccagttccagcagctcttcgtcatcaaccatgtcgcatttgttcaggaacacgatgatgtacggaacgcctacctgacgacccagcaggatgtgctcacgagtctgcggcatcgggccgtcagtcgcagcaactaccaggatcgcgccgtccatctgagcagcaccggtgatcatgtttttaacatagtcggcgtgccccgggcagtctacgtgtgcgtagtgacgggtcggggtgtcgtattcaacgtgagaagtgttgatggtgataccacgagctttttcttccggcgcgttatcgatctggtcgaatgcacgagcagcaccgccgtaggttttagccagtacggtggtgattgcagcggtcagagtagttttaccgtggtcaacgtggccgatagtaccaacgttaacgtgcggttttgtacgttcaaatttttctttagacacggctatattccttactatagtgctctccccttcaggagagagcacgggactttggtattaacccttaggcttatttaccacgggcttcaattacggcctgagcaacgttactcggcgcttcatcatacttcaggaattccatagtgtatgatgcacgacctttggtcagagaacgcagctgagttgcgtatccgaacatttcagacagcggtacttcagcgtggatcttaacgccagtaacttcagattcctgacctttgagcataccacgacgacggctcaagtcaccgataacgtcaccggtgttctcttccggagtttctacttcaaccttcatgatcggctcaagcagaactggtttcgctttcttaaagccttctttaaaggcgatagaagcagccagtttaaacgccagttcagaggagtcaacgtcatggtaagaaccgaagtgcagacgaatacccatgtctactaccgggtagcctgccagcggacctgctttcagctgttcctggatacctttatcaacggccgggatgtattcgccagggattacaccacctttaatgtcgttgatgaactcgtagcctttcgggtttgaacccggctccagcgggtacatgtcgataacaacatgaccatactgaccacgaccaccagactgtttcgcgtgtttaccttcaacatcggtaactttctggcggatagtttcacggtaagcaacctgcggtttacctacgttcgcttcaacgttgaattcacgcttcatacggtcaacgatgatgtcgaggtgcagttcgcccatacccgcgatgatggtctggttagattcttcgtcagtccatacacggaaagacgggtcttctttagccagacggcccagagccagacccattttttcctggtcagctttggttttcggttcaactgcgatggagattaccggctcagggaattccatacgttccagaatgatcggcgcatccgggtcacacagggtgtcaccagtggttacgtctttcagaccgatagcagcagcgatgtcgcccgcgcgaacttctttgatctcttcacgtttgttagcgtgcatctgaacgatacgaccgaaacgctcacgtgcagctttcacggagttcagtacggtatcaccagagttaaccacaccggagtaaacacggaagaaggtcaggttaccaacaaacgggtcggtagcgattttgaacgccagtgcagagaacggctcgtcatcacttgcgtgacgttcagccggagtgtctttaccgtcgtccaggataccgttgatcgcaggtacgtcaaccggggatggcaggtaatcaattaccgcatccagcatcgcctgaacacctttgttcttgaacgcagaaccacaggttaccaggatgatttcgttgttcagaacgcgctgacgcagagcacctttgatttctgcttcagtcagttcttcaccacccaggtatttttccatcagctcttcagaagcttcagctgcggattcgatcaggttctggtgccattcgttagccagttcaaccatgtctgccgggatatcttcgtattcgaaggttacgccctggtcagcgtcgttccagttgatagctttcattttcaccaggtcaacaacaccggtgaaatgttcttcagcaccaatcgccagctgcagcggaaccgggttcgcgcccagacgggttttgatctggttaacaactttcaggaagttcgcacccatgcggtccattttgttaacgaacgcaatgcgcggaactttatatttgtttgcctgacgccatacggtttcagactgcggctgaacaccaccaactgcgcagtaaaccattaccgcaccatcgagaacacgcatggaacgttctacttcgattgtgaagtcaacgtgccccggggtgtcgatgatgttgatgcgatgcggctcatactgcttagccataccagaccagaatgcagtagtcgcagcggaagtgatggtaataccacgttcctgctcctgctccatccagtccatggttgcagcgccgtcatgaacttcaccgattttatggtttacaccggtgtagaacagaatacgttcggtagtagtggttttaccggcgtcgatgtgcgcactgataccgatgttacggtagcgtgcgatgggtgttgtacgagccatttgtttcctcgtttatcttttaggcgttcaatttaagtagcccaaagcgggctgcttactggaagcgcccgcctggtgactaaaactccgaagggataaccaacggtagtgtgcgaacgccttgttggcttcggccatacggtgaacgtcttcacgtttcttaactgcagtacctttgttttctgcagcatcagaaagttcgttcgccaggcgcagagccatggatttatcaccgcgtttacgagcagcttcaacgatccaacgcattgccagagcattacgacgaaccggacggacttcaactggtacctgataagtagaaccaccaacgcggcgagacttaacttctacagtcgggcgcacgttttcgagagctacttcgaatgcttccagttcagatttaccagagcgctgagccagggtctccagcgcgctgtatacgatagattcagcagtagattttttaccatctaccatcaggatatttacaaatttagccagcagttctgatccgaacttcggatccggcagaattttacgctgaccaatgacgcgacgacgtggcatggaaatactccgttgttaattcaggattgtccaaaactctacgagtttagtttgacatttaagttaaaacgtttggccttacttaacggagaaccattaagccttaggacgcttcacgccatacttggaacgagcctgcttacggtctttaacgccggagcagtcaagcgcaccacgtacggtgtggtaacgaacacccgggaggtctttaacacgaccgccacggatcaggatcacggagtgctcctgcaggttgtgaccttcaccaccgatgtaggaagtcacttcgaaaccgttagtcagacgaacacggcatactttacgcagcgcggagttcggttttttaggagtggtagtatatacacgagtacatacgccacgtttttgcgggcatgcttccagcgcaggcacgttgcttttcgcaactttgcgagcacgtggtttgcgtaccagctggttaactgttgccattaaatagctcctggttttagcttttgcttcgtaaacacgtaataaaacgtcctcacacaatatgaggacgccgaattttagggcgatgccgaaaaggtgtcaagaaatatacaacgatcccgccatcaccaggccatctggctggggtgcttaaccgtaagtctgacgaaatcagtatagtcaatgagaatgatgtcgttcgaaatttgaccagtcaaaccgcgggcaataaggtcttcgttcagggcatagaccttaatgggggcattacgcagactttcaaggtagcggttaccgtcaactgcggcagttacgccatcttgcaataatagcagttcgtctccttcactgagcagacgcagcagcgcagcaaaatccgtcagccagggtgagcgatgtaatgtgtgcagcataaacgcctcaaaacctcaaaataacatcgtagttggcgagttcgcggcgtaaggcatctgcttcgagcggcgtggcttcgacaacaaagggtgtctgcggatctaacccgcgttcgcgcagtgaagccgcacaaacccagcactgttcaatgtcgtacagacccaacaatttaaaagtggcaatgtaatcacgcgccagcactgcatcgggcttttgtcctggcagcagctgaaaaacgccatcagctataaagaagacagccagatcgtcagttaatgcggaagttgccagtaaagcatctaaaccttcccggcctgcggctgtaccatgaggtgcagtagaaaaaacaaacgcaattcgtttcatcagaactgtaccaccctgtcacaggtcagcgaggcttccgccagcgccccaagtccgcttaaggtaaatccctgctgaaggtttgacgaagccagccccagtcttccggcctccgtttcatcaacaacgccacggcgtaatgctgccgctacgcagatattcagcgccacaccatgttgcgcattcagttgttgccaggcccgtacgaggtcaaattcgtcacttgccggagaggtcaattggttagcgttatagaccccttcccgatagaaaaagacgctgcttaactcatggccatctgctatcagcgcctgcgcaaactgaaaagcactactcgcctgttgcgtaccgtatgctggcccggtcaccacgatggcaaaacgcattacttatcttgcccctggaaatcaccgctcttgaactggcggatgtagagatagacagtgtgtttggagatgttcaggcggtcagcaacctggttgatcgcatctttaatatcgaagatccctttctcgtagagattcagcacgatctgacgatttttggcgttattagaaacattgcgatcggcattcacttcttcgatggtgaactccagcgtttgggtaaccagatcttcaacagaagaggcaaagttgacgcttgaaccgacatccggggtttctggcggcacaaaggtgctcataatctgcgagaagggaacatcaagattcatattgatgcacagcagaccaattacacgctgttcgcggttacgaatcgcgatagtcagggacttcattaatacgccgcttttggcgcgagtaaagtagcatttagaaacgctgctatccgctcccgtcatatcgtgcagcatacgtagcgccaggtcagtaattggcgaaccaatcttccggcctgtatgttcaccgttagcaatgcgaatggctgaacattttagatcctgcaaagagtgcaaaacgatttcacagtgggagccaataagcatcgctaacccgtccaccaccgcttcgtaggatttcagaatatcaaaatcggtctggtcgaaaggacgttgatccagtaaatccaactcactggtttcgttggttaaaagcgacctggacatgaaaaaaaacactccttttcaggagcctgtcgttaacttttcagggcaggctcattaatgatgcgggtaactaaattaatacagcggaggttccgctttccagcactaattatatccggcctgtaataaaaaaaccgccgcctggtcaggcggcggttcttaatgcttattttttagcagaatctgcggctttcgcatcagcttccggctttgcatcagccttcggcgctggtttcacatccagcagctctacgtcaaacaccagggtagaattcggtgggatccccggaacacccgctttgccgtaagccagttctggtggaataaccagtttgatcttaccgcctttcttgatgttcttcagaccttctgtccaacccgggataacaccgtccagacggaaagaaagcggttcaccacgggtgtaagagttgtcgaactctttaccgtcgatcagcgtacctttgtagttcactacaacagtatcgctgtctttcggtgcttcgcctttaccggcttctactacctgataaaccagaccagttgaagaggttttcacacctttctctttggcaaatttctcgcggtactctttaccttttgcttcgttatcagccgcgtctttttccatcttcgcctgagcagaagacttcacgcgagcttcgaatgcttgtagagtctgttcgatctcttggtcggagagtttgctcttatcagcaaatgcatcctgaacaccagcgatcagctgatctttatccagtttgatgcccagtttttcttgttcttttagagagttttccatgtaacgacccagcgaggcacccagtgcataagctgatttctgatcgtcatttttgaacgctgctttgctgtcagcagctgtagcaggttttgcagcttcagcagcaaaagtgattggtgcatgcagggcaacggccattgtggtcgccagcagcgttactttaaacagtgatttcatccatatctccaggatcggggcatctcaccccagggttaactattatcagaagggtactataaagcgttgtcgaacaaatctacatacagacacgccctattatcatctattttcagactctttttgtttaaattagtttcgatgaccgcgaaatgagtgctgtctcgggcagcaaagttaagtagaatccgcggcgaccattcgacaaaagaggtgaatcatgcaggatttatcattggaagcacgcctggcagagctggagagccgactggcttttcaggaaatcaccattgaagaactgaacgtcacggtgaccgctcatgaaatggagatggcgaaactgcgcgatcatctgcgtctgctgaccgagaagttaaaagccagccagccgtcgaacatcgcgtcgcaggctgaagaaacgccaccgccacattattgaggcgtaaaaaaagcggggattccccgcttttttgtcactttttcggtattagtggcaaccgcaaccgccgttgcctttaccgccacagcagccttcgccaccgtgttcatgaccgtgatcgtggccatgaccgccgcagcaaccgtcgtggtcgtgatcgtggtggtgatcgtgcgcgccgtgaacgtgaccatgagccagttcttcttcagtcgcttcgcgaatcgccacaacttcaacgttgaatttcaggttctgaccggccagcatgtggttaccatcaaccacgacgtgatcgtcttcaaccgcagtgatttcaaccggtaccggaccctggtcggtttcagccaggaaacgcatacctacctgcagttcatcaacgcccataaatacgtctttaggaacacgttgcaccaggttttcgtcgtactgaccgtaagcgtcgttcgcgccaacagcgacatcaaatttgtcgccaacttcatgaccttccagcgccgtttccaggccagagatcagggaaccgtgaccatgcaggtagtccagcggcgcactcaccggagactcatcaaccaacacaccgtcttctgtacgtacctgataggccaggctgaccaccaggtcttttgctactttcatgatatctcctgagcatgggaagaatagtggcgcagattgtagcggaattctgcagccgtgtactcactagcttaaaaaaactcggcgcatatcgctagtccggatgaaaaatcccgatcacttgctcatctttgcgaacgtgatcgcgggcttctttgtctgcttctcgcatctgatgtccgcacttaacacattcaacaatatcaatattattttcgcgccacatcgccattgaatcctgcgcctgacaggccgggcattttgcgcccgcaataaaacgttttcggattgccatctttaccctctactcaaattcatcccagccgtccagctggcgtcgttcttgttgcatttcacgctggaaaatctcttccagttcgcgtcgggcttccctggcgcgagaaatttgtacggtatcggcatgcattgggatgagctctcgcagcatccgcatatccaggcggcgaaaatgcagttgcgctcgctgtgcctgatgcggatgcatgccaagcgtgaccagcgtcttgcgccccagctctaacgcactggagaatgtttcacgggaaaactgcgtcacccctgcctgtaataactcatgcgcttccacacgtccgcgcgctcgcgcaagaatatgcaaatgcggaaagtgctgttggcatatttccaccagcttcatggtgtcttccggctcgttacaggtaatgacgatagactcagcggcctctgcacccgcagaacgtaaaagatcgacctgcgtggcgtcgccgtaataaactttgtagccgtatttacgcatcaggttaacggcgctgatatcccgctccagcacggtaatgcgcattttatttgccatcagcaaacgaccaatcacctgaccaaaacgcccgaagcccacgacaatgacctggggtttatcatcgttgacccacggtttttcgtcttcttcttccggtccgttaaactggcgggatagccatttatccaccagcttcatcagcaacggcgtggtcatcatggaaagcgtcaccgtcaccagcaacaacgccatctggtcgccctggaataagcgttgtgaagaagcggtagaaaagaggacaaaggcaaactcaccaccctgactcaacacgccagcaaactgcatccgctctgagctacgcacgccatacaatcgcgccagcagatacagcacgagaattttcaccgccaccagcacaaccacgcttatcactacccacaacagatgggtataaagcaccccgaggttgagtgacatgccgacagagataaagaacaaaccgagcagcaagcctttgaagggatcgatagccgtttccagttcatggcgatattcactttccgccagcagcacgcccgcaataaatgtaccgagcgccatcgacagccccagcgcatccataaacaatgcggaacccaacaccagcagcagcgtcgcggcggtgaacacttcccgcacgccagaagctgcaataaagcggaataccggacgcagtaaatagcgcccaccaatcagcatgccgacaaacgccagcaccttcatgccgaccttcatccagtcgaaatgttcgtctgccgaccccgccaacaacggcactaacgccagtgctgggattactgccagatcctgaaacagcagaaccgaaaacccgagctggccggattcgctgcgattcatccctttctcacgcatcaattgcaacgccattgcagttgaagacatcgcaaggccaatgccaccgaccaccgccgcctgccaggcgaaatccgtcagcatcaataatcccgccagcaacgccgcgcttaacagcacctgtgccgcgcctacgccaaaaatcgaacgccgcagttgccaaagtttggagggattcaactcaaggccgatgataaacatcaggaataccacgccgagttccgaaaagtggaggatctcatcgacgtcgctaataaaccccagcccccacgggccaattgcaatccctgccagcaaatatcccaacacagcgccaatacccagccgcgatgccagcggcaccgcagccaccgccgcgaagagaaacagcactcctgcgagtaaaaaatcggaaccttccatcagcggcctcctggagacagcggatttgccagccagtcaccgtaggctctggcgtggctcgccagctcctgtgcgctttgccgtctcgcccagtaaataatgatgggacttaaccaatgcatccggcacatgcccgccgccagttcaaaggggcgcagcacatcgctcatcgggtagcgattcagcgcgtcataacggtaagcactttccggctcgccggtggtaatcacgctacgccagtactttcccgccagttggtttcctcccggcccgctggcaaaaccacgacttaatacccggtccagccactctttcagtagcgccgggcagctataggtataaagaggatgctgaaagacaatcacctcgtgctcgcgcagtaatgcctgctcacgggggatatcaataaaaaaatcgggatagtgcgcgtaaaggtcgtgcacggtaacattgctgagctgcgtggccggtttaagcagtacccggtttgccaccgagtcctgagattccggatgggcatacagcagcaaaactttcgctggctgagacatcatccccctcccggtatggtttttgtgtatagtcgctgttttgggctaccattgcgcccggtgcggcagctcgcccatacattacattatcataatgataagttaacatagtctgaacatacggcaccttatgattgttttctcctcgttacaaattcgtcgcggcgtgcgcgtcctgctggataatgccaccgccaccatcaaccctgggcagaaagtcggcctggtgggtaaaaacggctgtggtaaatctaccctgctggcattgctgaaaaatgaaatcagcgccgacggcggcagctacacctttccgggaagctggcaactggcgtgggtgaatcaggaaacgccggcgttaccgcaagcggcgctggaatatgtcattgacggcgaccgtgaatatcgtcaactagaagcgcagctacacgacgccaacgaacgtaacgacgggcacgccattgcgaccattcatggcaagctggatgctattgacgcatggagtattcgctcccgtgctgccagcctgctgcacggcctcggtttcagcaatgaacaactggagcgcccggtaagtgatttttccgggggctggcgtatgcgtcttaaccttgcccaggcgctgatttgccgttcagacttgctgctgctcgacgaaccgactaaccacctcgatctcgatgccgttatctggctggaaaaatggctgaagagctatcagggcacgctgatcctgatctctcacgaccgcgacttcctcgatccgatcgtcgataaaattattcatatcgaacaacaaagcatgttcgagtacaccggcaactacagttcgtttgaagtacagcgcgccacccgtctggcgcagcaacaagcgatgtacgaaagccagcaggaacgcgtagcgcatctgcaaagttatatcgaccgtttccgtgccaaagccaccaaagcgaagcaggcccagagccgcattaagatgctcgagcgtatggagctaattgcccccgcgcacgtcgacaacccgttccgctttagcttccgcgcgccggaaagcctgccaaatccgttactgaagatggaaaaagtcagcgcgggctatggcgatcgcattattctcgactcgattaaactgaacctggtgcccggctcgcgtattggtctgttaggccgcaatggcgcgggtaaatcgacattaatcaaactgttagccggtgaacttgcgccagtcagcggtgaaattggtctggcgaaagggatcaaactcggctacttcgcccagcatcaacttgaatacctgcgcgccgacgaatcacctattcaacatctggcacgtttagcgccgcaggagctggaacaaaaactgcgtgactacctcggcggctttggtttccagggcgataaagtaaccgaagaaacgcgccgcttctccggtggggaaaaagcccgcctggtgctggcattaattgtctggcagcggccgaatctgctgctgctcgacgaaccgactaaccaccttgacctcgacatgcgtcaggcactcaccgaagcattaatcgagtttgaaggcgcgctggttgtcgtttcgcacgaccgtcatttgctgcgttccaccactgacgatctctacctggttcacgatcgtaaagtcgaaccgttcgacggcgatctggaagattatcaacagtggttgagcgacgtacaaaagcaggaaaaccagaccgacgaagcgccaaaagagaatgcgaacagcgcccaggcacgtaaagatcagaagcgtcgggaagctgagctgcgtgcgcaaacccagccactgcgtaaagagattgcccgtctggaaaaagagatggagaagctgaacgcgcaactggcgcaggcggaagagaaactcggcgacagcgaactgtatgaccagagccgtaaagcggagttgaccgcctgcctgcaacagcaagccagcgccaaatccggcctggaagagtgcgaaatggcatggctggaagcccaggagcagcttgagcagatgctgctggaaggccaaagcaactgatggcgcagataacgacgaccgatgccaatgaattcagcagcagtgctgaattcatccccatgcgcggctttagcaattgtcatctgcaaaccatgctgccgcgtctgtttcgtcgtcaggtgaaattcaccccgtactggcagcggctggagttgcccgacggcgattttgtcgatcttgcgtggagtgaaaaccctgcacaggcgcaacataaacctcgtctggtggtgtttcacgggctggaaggcagtctcaacagcccttacgcccacggtctggttgaggcggcgcaaaagcgcggctggctgggcgtggtgatgcattttcgcggatgcagcggtgaaccaaaccgtatgcaccgcatttaccattcgggcgaaaccgaagacgccagttggtttttacgctggctgcaacgcgaatttggtcatgcgccaacggctgccgtcggctattcgctcggcggtaatatgctggcctgtttgctggcaaaggaaggcaatgatctcccggttgatgcggcggtgattgtctctgcgccgtttatgctggaagcctgtagctatcatatggaaaagggcttttcccgcgtttatcagcgttacttgctgaacctgttaaaagccaatgccgcgcgcaagctggcagcctaccccggaacgctgccgattaatctcgcgcagttaaaatcggtacgtcgcatccgtgaatttgacgatctcatcaccgccagaattcacggctacgccgacgctatcgactattatcgtcagtgtagcgccatgccgatgctgaaccggatcgccaaaccgacgctgattattcacgccaaagacgatccgtttatggatcatcaggtgatcccgaaaccggaaagtctccccccgcaggtggagtatcaactgactgaacatggcggtcatgttggctttattggcggtacattacttcatccgcaaatgtggctggagtcacgcattcctgactggttaacaacgtatctggaggcgaaatcatgttgattccgtggcaagacctctcccccgaaacgctggaaaatttaattgaaagctttgtgttacgtgaaggcaccgattatggtgaacatgagcgtacacttgaacagaaagtcgccgacgtcaaacgccagctacagtgcggagaagcggtgctggtatggtcggagctgcacgaaacggtcaatattatgccgcgcagtcagtttcgcgaataacctgcaaccgtcggcggacgagataataatgatagctaagtcatggagttactatgtctgccaaacatccggtcattgcggtaacaggatccagcggcgcggggaccaccaccaccagcctcgcgtttcgtaaaatattcgcgcagttaaatctgcatgcagctgaggtggaaggcgacagttttcaccgttacacccgcccggaaatggacatggcgatccgcaaagcgcgcgacgccgggcggcatatcagctacttcggccccgaggctaacgacttcggcctgctggaacaaaccttcattgaatacggtcagagcggcaaagggaaatctcgcaaatatctgcatacctacgacgaagccgtaccgtggaatcaggtaccggggacattcaccccctggcaacctttaccggaacccactgatgtactgttttatgaaggtttacacggcggcgtagtcacgccacagcataacgttgcgcagcatgtggacttactggtcggcgtggtgcctatcgttaaccttgagtggattcaaaaactgatccgcgacaccagcgagcgcgggcactcacgagaagcagtgatggactcagtagtgcgttcaatggaagactatatcaactacatcacaccgcagttttcccgcacccatcttaacttccagcgcgttcccaccgtcgacacttcaaacccgttcgcggcaaaaggtatcccgtcgctcgatgaaagctttgtggtgatccattttcgtaatctggaagggatcgatttcccctggctgctggcgatgttgcaaggctcattcatttcccacatcaatacgttagtggtaccgggcggcaaaatgggtctggcaatggaattaattatgctgccgctggtgcaacgattgatggaaggaaagaaaatcgagtaactctgctattacgccggataaaatactatccggcttcacaacgggatagttaagtcacgcggcaaccacttcatacgagtgagtaatattcaccgctttttccagcatcaacgccactgaacaatatttctcggcagagagatcaaccgcacgcgcaaccgctgcgtctttcaggtcgcgaccggtgacgataaaatgcagattaatgtgcgtaaacaggcgtggtgcctcttcgcggcgttcagaggtcaattttacttcacaatcgaccacatcctgacgccctttttgcaggatcgaaaccacatcgatggcactgcaaccacccgccgccatcaacaccatttccatcggacttggtgctttatcgcctgagttgccgtccattaaaatctgatgaccagaggcggattcgcccagaaaagttaacccttcgacccacttcactcgcgcttgcatttttgctactccactgcgtcaattttcctgacagagtacgcgtactaaccaaatcgcgcaacggaaggcgacctgggtcatgctgaagcgagacaccaggagacacaaagcgaaagctatgctaaaacagtcaggatgctacagtaatacattgatgtactgcatgtatgcaaaggacgtcacattaccgtgcagtacagttgatagccccttcccaggtagcgggaagcatatttcggcaatccagagacagcggcgttatctggctctggagaaagcttataacagaggataaccgcgcatggtgcttggcaaaccgcaaacagacccgactctcgaatggttcttgtctcattgccacattcataagtacccatccaagagcacgcttattcaccagggtgaaaaagcggaaacgctgtactacatcgttaaaggctctgtggcagtgctgatcaaagacgaagagggtaaagaaatgatcctctcctatctgaatcagggtgattttattggcgaactgggcctgtttgaagagggccaggaacgtagcgcatgggtacgtgcgaaaaccgcctgtgaagtggctgaaatttcgtacaaaaaatttcgccaattgattcaggtaaacccggacattctgatgcgtttgtctgcacagatggcgcgtcgtctgcaagtcacttcagagaaagtgggcaacctggcgttcctcgacgtgacgggccgcattgcacagactctgctgaatctggcaaaacaaccagacgctatgactcacccggacggtatgcaaatcaaaattacccgtcaggaaattggtcagattgtcggctgttctcgtgaaaccgtgggacgcattctgaagatgctggaagatcagaacctgatctccgcacacggtaaaaccatcgtcgtttacggcactcgttaatcccgtcggagtggcgcgttacctggtagcgcgccattttgtttcccccgatgtggcgcagactgatttatcaccccgatatcaactatgcacttcgacaaacgctggtgctatgtttgcccgtggccgttgggttaatgcttggcgaattacgattcggtctgctcttctccctcgttcctgcctgttgcaatattgcgggccttgatacgcctcataaacgttttttcaaacgcttaatcattggtgcgtcgctgtttgccacctgtagcttgctgacacagctactactggcaaaagatgttcccctgccctttttgctgaccggattaacgctggtacttggcgtcactgctgagctggggccattgcacgcaaaattgcttcctgcatcgctgctcgccgccatttttaccctcagtttggcgggatacatgccggtctgggaaccgttgctcatctatgcgttgggcactctctggtacggattgtttaactggttttggttctggatctggcgcgaacaaccgctgcgcgagtcactaagtctgctgtaccgtgaactggcagattattgtgaagccaaatacagcctgcttacccagcacaccgaccctgaaaaagcgctgccgccgctgctggtgcgccagcaaaaagcggtcgatctaattacccagtgctatcagcaaatgcatatgctttccgcgcaaaataatactgactacaagcggatgctgcgtattttccaggaggcgctggatttacaggaacatatttcggtcagtttgcatcagccggaagaggtgcaaaagctggtcgagcgtagccatgcggaagaagttatccgctggaatgcgcaaaccgtcgccgctcgcctgcgcgtgctggctgatgacattctttaccatcgcctgccaacgcgttttacgatggaaaagcaaattggcgcactggaaaaaatcgcccgccagcatccggataatccggttgggcaattctgctactggcatttcagccgcatcgcccgcgtgctgcgcacccaaaaaccgctctatgcccgtgacttactggccgataaacagcggcgaatgccattacttccggcgctgaaaagttatctgtcactaaagtctccggcgctacgcaatgccggacgactcagtgtgatgttaagcgttgccagcctgatgggcaccgcgctgcatctgccgaagtcgtactggatcctgatgacggtattgctggtgacacaaaatggctatggcgcaacccgtctgaggattgtgaatcgctccgtgggaaccgtggtcgggttaatcattgcgggcgtggcgctgcactttaaaattcccgaaggttacaccctgacgttgatgctgattaccaccctcgccagctacctgatattgcgcaaaaactacggctgggcgacggtcggttttactattaccgcagtgtataccctgcaactattgtggttgaacggcgagcaatacatccttccgcgtcttatcgataccattattggttgtttaattgctttcggcggtactgtctggctgtggccgcagtggcagagcgggttattgcgtaaaaacgcccatgatgctttagaagcctatcaggaagcgattcgcttgattcttagcgaggatccgcaacctacgccactggcctggcagcgaatgcgggtaaatcaggcacataacactctgtataactcattgaatcaggcgatgcaggaaccggcgtttaacagccattatctggcagatatgaaactgtgggtaacgcacagccagtttattgttgagcatattaatgccatgaccacgctggcgcgggaacaccgggcattgccacctgaactggcacaagagtatttacagtcttgtgaaatcgccattcagcgttgtcagcagcgactggagtatgacgaaccgggtagttctggcgatgccaatatcatggatgcgccggagatgcagccgcacgaaggcgcggcaggtacgctggagcagcatttacagcgggttattggtcatctgaacaccatgcacaccatttcgtcgatggcatggcgtcagcgaccgcatcacgggatttggctgagtcgcaagttgcgggattcgaaggcgtaatgcaggctaaaccatcggataaggcattcacgccgcatccgacatcttttgcctgatgcttcgtatttacgccccaaccaccttcgccaccgcgtgggcgaaacgttgcatcccttcatcgatatccgcatcttccaccaccagcgacggtgcaaaacgcatcacatccggtccggcattcagcaccattacgccagcctctgcgcccgcatacaggaaatcacgcgcccgacctttgtactgtggtttcagctctgcgccaatcaacagccccataccgcgaatatcgctaaatacatcgtactgctgatcgatcttctgcagatggtcaacaaaacgctggcgtttcgcctgaatgccttccagcacttcaggggtattgatgatatcaaacgccgcccccgctactgcacaggccagaggattaccgccgtaggtggaaccgtgagaaccaggatgaaacgcagaagcaatttccgccgtggtcagcatggcgctaatcgggaagccgccgcctaacgctttcgcagaggtcagaatatccggcgtaacgccgtagtgcatgtaagcaaacaaatcgccggtccgccccatcccgcactgcacttcatcaaacaccaataatgcctgatgttgatcgcacagctcgcgcaagccctgcaaaaactctggcgtcgctgccgtcacaccgccctcgccctggatcggctcaaccaccaccgcacaggtgtgatcatccatcaccgctttcactgcatggagatcgttaaagggaacgtggatgatgtctgccggtttcggcccaaagccgtcggaatattttggctgcccacccaccgaaacggtaaacagcgagcgaccatgaaaagcgttatggaaggcaataattttggttttgaacgggctatgacgcacacaggcgtaatggcgtgccagtttaaaggcggtttcgttagcttccgtgccggagttcataaacaccacgcgttcggcaaacgttgcctcaatcagtttacgcccaagacgcagcgccggttcattggtgaaaacgttactgatatgccacagagtttcgccctgggtttttaacgcgttcaccagcgcaggatggcaatggcccaacgccgtaactgcaatgccacccgcgaaatcgacatactccttgccttgctgatcccagattcggctgccctgaccttttaccggaataaactctgccggagcataaatcggcaggatcacttcatcgaaagtcgcgcgtgtaattgctgtttgttcaattgccatctcatgatcaccctgttacgcataaacaaatgtgaaattataaccacaaaatatgcataaaaaatcactaaatggcaatcagaaatcagcgatgcaggaaattagccagcagttgatgtccttgttcgctaagaatactttctggatggaactgcacaccttccagatcccactggcgatggcgaatccccataatctctcgggtttcgctccaggccgtcacgtcaaagcacgctggtaatgagtcaggttccaccaccagcgaatggtagcgtgtcacggtaagtggatttgccagcccccgaaatacgccctcaccgttatgtgtaatcggcgaggttttgccgtgcatgacctttgcggcgcgcacaactttaccgccaaatgcctgcgccattgcctgatgaccgaggcagacgccaagaatcggcaagcgcccggcatagtggcgaataacgtcaagggagatcccggcttcatctggcgtacaggggccaggtgagatgacaattttttgtggtttaagggcgtcgatatccgccagcgtcaacgcatcgttgcgcttaaccagcacatccgcccccagttcacaaaagtactggtagaggttccaggtaaaagaatcgtagttatctataagcaggatcatggcggctccggtacaaaagaaccgcgctattttactcagattccccggcttcgcttaccactttgctaaatatcatctgcagtgcggtgagatcccccattgccccactctgatttgcctgattccaggcctctttttcgataccctgccagctcagttgatatccggcatgaatcgccagttgctcgaagaagatccgctgtgccagaccacttcccacccggaagggatgcagcacgttgatttcacaatagtaatgcgccagccgctcgacgaacttcgctttctccaggccaaccagataaccttcttcctccagatcctgcatcagggcattgccctctttttcgatataagcaaagtggcagaacggcgtatcaccctgataaatatcaacttcacgcagttgccctgcccagtcgaaaatatcctgatacagctggcgatggatagttcgcaaatgcggtaaaccgcgcaccagcggaccaagctcaatggtcgcagcacgcagcgccgtcatttcgtaagcggcctgttccagccgctgctgctggcggatgttcagccggttacgcatgatatcaaggcctggataaagatacggatcgcgcccttcgccgaatttatcgctcatagtgactcctcagctcttcaaggcgcgctaaagcctctgcggcagtaagagtgactaaaggcatctcgacgccttcaagacggcgactggcctgaaaattacgattacgctgaagctcccagagacgggacttttgcttatcggtgagtttcttcacttgatgcctccctgaacgtgtccatttgccacaagtataagcggcaaatccgggttacgccgggagagcagaagcgcgggcaagattgcccgcgcgagaaatcattacggcaggactttagcggaaaggataactaccggttttgacggcacattctggtacggaccaacgtcatgagtcggcacctgggaaatcttatcggcaacgtccatgcctttcaccactttaccaaataccgcgtaaccgaaatcacgctgaccatggtcaaggaaggcgttatcggcaacgttgataaagaactggctggtggcgctgtctttgtcagcggtacgtgccatcgcgatggtgccacgcgtgttgcgcaggccgttatcggcttcatttttgattggcgggtttggttttttctgctgcatctgctcggtgaaaccgccgccctgaatcataaagccaggaatgacgcggtgaaaggtagtgttgttataaaaaccgctgttcacataatcgacaaagttttgcacagacactggcgctttttgtttatccagctccagttcgatgttaccagctgaggttgtcaacaatacgtgcgggtcccctttcgctgccattgctgcgggagaaagagcagaaagagcgaaaacagcagccatcgccgccagggtcgatttgaacatgagatttccttaacaaacagagcagaaaaaaagcaagtgaagagattctaaatagccttcaagaacaaggccatccctttacctaattttacgtatctgaaatatatgtaacctgacgatcactttttattccgtgatcaaaatcacctcttaaaatgcaatttagcaaccgattgcaataaaacatttaaacagatcacaaaatcacctaaaatcgcccgctcgcggcatatcccgctatgccattttatttttgaacgcaggccaatcatgactaacagcaatcgcatcaagctcacatggattagctttctctcctacgcactgactggtgcgttggttattgtcaccgggatggtgatgggaaatatcgccgattatttcaatctgcctgtttccagtatgagtaataccttcaccttcctcaacgccggcattttaatctctatcttcctcaacgcctggctgatggaaatcgtcccgttgaaaacgcagttacgttttggctttctcctgatggtgctggcggttgccggtttgatgttcagccacagcctggcgctgttctcggcggcgatgttcattctcggggtggtcagcggcatcaccatgtcgattggtacattcctggtaacacaaatgtatgaagggcgtcagcgcggttcccgcctgttatttaccgactccttcttcagtatggctgggatgattttcccaatgatcgccgcgtttctactggcgcgcagcattgagtggtactgggtttatgcctgcatcgggctggtgtatgtcgctatttttattctgaccttcggctgtgagttcccggcgctgggcaaacatgcgccaaaaacggatgctccggtagagaaagaaaagtgggggatcggcgtactgtttctctctgttgcggcgttgtgctacatcctcggtcagttaggttttatctcctgggtgcctgagtatgccaaaggcctgggcatgagcctgaacgacgcgggcacgctggtgagtaacttctggatgtcatacatggtcggcatgtgggcgttcagctttattcttcgcttctttgatttgcaacgcattctgaccgtactggctggtctggctgcgattctgatgtacgtctttaacaccggaacaccagcacatatggcgtggtcaattctcgctctgggcttcttctccagcgcgatctataccaccatcatcaccctgggttcacagcagaccaaagtaccgtcgccaaaactggttaactttgtcctgacctgcggaaccatcggtactatgttgacctttgtggttaccggcccgatcgttgaacatagcggtccgcaggcggcactgcttacagcaaacggtctgtacgctgtcgtctttgtgatgtgcttcctgttaggtttcgtcagccgtcaccgtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtaggcggtaatagaaaagaaatcgaggcaaaaatgagcaaagtcagactcgcaattatcggtaacggtatggtcggccatcgctttatcgaagatcttcttgataaatctgatgcggccaactttgatattaccgttttctgtgaagaaccgcgcatcgcttatgaccgcgtacacctctcgtcttacttctctcaccacaccgccgaagagctgtcgctggtgcgcgaaggcttctacgagaaacacggcatcaaagttctggtcggcgaacgcgctatcaccatcaaccgtcaggagaaggtgattcactccagcgccggacgtaccgttttttatgacaagctgatcatggcaaccggttcctacccgtggatcccgccaatcaaaggttctgatactcaggactgctttgtctatcgcactattgaagacctcaacgccattgaatcctgcgcccgtcgcagcaaacgcggtgccgttgttggtggcggcctgttaggtctggaagccgcaggcgcgctgaaaaacttaggtattgaaacccacgttatcgaatttgcccctatgctgatggcagaacagcttgatcagatgggcggcgagcagctgcgtcgcaaaatcgaaagtatgggcgtgcgcgttcacaccagcaaaaacacccttgagattgtgcaggaaggtgttgaagcgcgtaaaaccatgcgttttgccgacggcagcgaactggaagtcgactttatcgtcttctctaccggtatccgtccgcgcgataagctggcaacccagtgtggtctggacgttgctccgcgtgggggtattgtcattaatgattcctgccagacttccgatccggatatctacgccatcggtgaatgcgcaagctggaacaaccgtgtatttggtctggtagcacctggctacaaaatggcgcaggtcgccgttgaccatattctcggtagcgaaaacgcctttgaaggtgctgaccttagcgccaagctgaaactgctgggcgtagacgtaggcggtattggtgatgcgcacggtcgcacgcctggcgcacgtagctacgtttacctcgacgaaagtaaagagatctacaaacgcctgattgtcagcgaagacaacaaaaccctgctcggtgcggtactggtgggcgataccagcgactacggtaacctgctgcaactggtgctgaacgctatcgaactgccggaaaacccggattccctgatcctgccagcacactcgggtagcggcaagccgtctatcggtgttgataaactgccggacagcgcgcaaatctgctcctgcttcgacgtcaccaaaggtgatctgattgctgccatcaacaaaggctgccacacagttgcggcgctgaaagctgaaaccaaagcgggtactggctgcggtggctgtatcccgctggtcactcaggtactgaacgcggaactggcgaaacagggcatcgaagttaacaacaacctgtgcgaacactttgcttattcgcgtcaggaactgttccatttgatccgcgttgaaggcattaaaaccttcgaagaactgctggcgaaacacggcaaaggctacggttgtgaagtttgtaaaccaaccgtcggttcgctgctggcctcctgctggaacgaatacattctgaagccggaacatactccgctgcaggattctaacgacaacttcctcgctaacatccagaaagacggcacctactcggtgatcccgcgttctccgggcggtgaaatcaccccggaagggctgatggcggtaggtcgtatcgcgcgtgaatttaatctctacaccaagatcactggctcccagcgtctggcgatgtttggcgcacagaaagacgatctgccggagatctggcgtcagctgattgaagccggcttcgaaaccggtcatgcctatgcgaaagcactgcgtatggcgaaaacctgcgtgggtagcacctggtgccgctacggcgttggcgacagcgtcggcctcggcgtggaactggaaaaccgctacaaaggcatccgtacgccgcacaaaatgaagttcggtgtctccggctgtacccgtgaatgttcagaagctcagggtaaagacgtgggtattatcgccactgaaaaaggctggaacctgtatgtttgcggtaacggcggcatgaaaccgcgtcatgcggatctgctggcggcggatatcgatcgcgaaacgctgatcaaatatctcgaccgcttcatgatgttctacatccgtactgccgacaaactgacgcgtaccgcaccgtggttagaaaacctcgaaggcggcatcgattacctgaaagcagtgatcattgacgacaaactggggctgaacgcacatctggaagaagagatggcgcgcctgcgtgaagcggtactgtgtgagtggactgaaacggtcaatacgccgtctgcgcagactcgcttcaaacacttcatcaacagcgacaagcgtgacccgaacgtgcagatggtgccagagcgcgaacagcaccgtccggcaacgccgtatgaacgtatcccagtaactctggtggaggacaacgcatgagccagtggaaagacatctgcaaaatcgatgacatcctgcctgaaaccggcgtctgcgcgctgttaggtgacgagcaggtcgcgattttccgcccgtatcacagcgatcaggtgtttgcgatcagcaacatcgacccgttcttcgagtccagcgtgctgtcacgcggactgattgcggaacaccagggcgagctgtgggtcgccagcccgctgaaaaaacagcgttttcgcttaagcgacggcttgtgcatggaagacgaacagttttccgtcaaacattacgaagcgcgagtgaaagacggcgtggtgcagctgcgcggttaatgttttaacgggaggcgcaatgcctcccctttttgcatggtcctgtaataatcttcggtatattgcaggacattttttaaactttttgttttattttttgtttttattttttaaaggataatcaaatgtttacagacactattaataagtgtgcggctaacgctgcgcgcattgcacgcctgtcggcaaataacccgctcggcttttgggtcagctccgccatggcgggcgcgtatgtgggtcttgggatcatcctgattttcacgctcggtaatttgctcgatccatccgtacgccctttggtgatgggcgcgacctttggtatcgccttaacgctggtgattatcgccggttctgaactgttcaccggacacaccatgttcctcacctttggggtaaaagcgggcagcatcagccacgggcaaatgtgggcaatcctgccgcaaacctggctgggtaacctggtcggttccgtcttcgttgccatgctctatagctggggcggcggtagcctgctgccggtagataccagcatcgttcactccgtcgcgctggctaaaaccactgcaccggcaatggtactcttcttcaaaggtgcattgtgtaactggctggtttgcctggcaatctggatggcgctgcgcactgaaggggcggcgaaatttatcgctatctggtggtgtctgctggcatttatcgcgtccggctacgagcactctatcgctaacatgacgctgttcgcgctctcctggttcggcaaccacagcgaagcctacacgctggcgggtattggtcataacctgctgtgggtgacgctgggtaatactttatcaggtgccgtattcatgggattgggttattggtatgctacgccgaaagcgaatcgtccggttgcggacaaatttaatcaaactgaaacggctgccggttaattactaaggggtttttacgtggatcatttgcctatattttgccaattacgcgatcgcgactgtctgattgtcggcggtggtgatgtcgcggaacgcaaagcaaggttgctgttagacgcaggcgctcgcttaacggtgaatgcattagcgtttattccacagttcaccgcatgggcagatgcaggcatgttaaccctcgtcgaagggccatttgatgaaagccttctcgacacctgctggctggcgattgcagcgacggatgatgacgcgcttaaccagcgcgtcagcgaagccgctgaagctcgtcgcatcttctgtaacgtggtcgatgcgccgaaagccgccagctttattatgccgtcgattattgaccgctcaccgctcatggtagcggtctcctctggcggcacctctccggttctggcacgcctgttgcgcgaaaaacttgaatcactgctgccgttacatctgggccaggtagcgaaatacgccgggcaattacgcgggcgagtgaaacaacagttcgccacgatgggtgagcgtcgccgtttctgggagaaattgttcgttaacgaccgcctggcgcagtcgctggcaaacaacgatcagaaagccattactgaaacgaccgaacagttaatcaacgaaccgctcgaccatcgcggtgaagtggtgctggttggtgcaggtccgggcgatgccgggctgctgacactgaaaggactgcaacaaattcagcaggcagatgtggtggtctacgaccgtctggtttctgacgatattatgaatctggtacgccgcgatgcggaccgtgttttcgtcggcaaacgcgcgggataccactgcgtaccccaggaagagattaaccagatcctgctgcgggaagcgcaaaaaggcaaacgcgtggtgcggctgaaaggtggcgatccgtttatttttggccgtggtggcgaagagctggaaacactgtgcaacgcgggtattccgttctcggtggttccgggtattaccgcagcttctggttgctctgcctattcgggtattccactcacgcatcgcgattatgcccagagcgtacgcttaattaccggacacttaaaaaccggtggcgagctggactgggaaaacctggcggcagaaaaacagacgctggtgttctatatggggttgaatcaggccgcgactattcagcaaaagctgattgaacacggaatgccaggcgaaatgccggtggcaattgtcgaaaacggtacggcagtcacgcagcgcgtgattgacggtacgctcacacagctgggagaactggcgcagcaaatgaacagtccatcgctaattattattggtcgggttgttggcctgcgcgataaactgaactggttctccaaccattaatttaacccgggccagagaattctggccttcttaatgactctttttatatattcagcaaataaaacatagccccttaataaatattatctgctaatgggttatattcaccgttacagcgacttacaaaattaagtcattcgctcactgacgccaattaaatattcctgtatcgttcttaacgagcagtctgcttatattcatataatcaatgaatattaattaatatataatacatagggaatgtaaatgaacaaatttattaaagttgcactggtaggtgcagtactggctacgttaactgcatgtactggtcatattgaaaaccgtgataagaactgctcttacgactacctgctgcacccggcaatttctatttctaaaatcattggcggttgcggtcctactgcacagtaagtctctgacagaaatcggctaacaccggtttaattgcccgacgccctctggattttccgagggcgtatttgtttctatgtccttcttgcccccgcccgtaaaaatattttcactttaaattcaatttgataactacatccattagccacagcgcgatcctgtgcgaaattttgtgatcttcctccacattacataacatcatatgttgttatattcatcatgcattgtcatgttaccttttaaatgactgcaaactctcccctacaacgtattggacaagaaaaaggtatcgctatgggaagccaggaactccaacgcaagctcggattttgggccgttcttgcaatcgccgtcgggacaaccgtcggctccggtatttttgtatctgtgggtgaagtggcaaaagcagcgggcacgccgtggcttacggtgctcgcgtttgtcattggcgggttaattgtgatcccgcaaatgtgcgtctatgcggaactatccaccgcttatccggaaaatggcgcagattatgtttatctgaaaaatgccggaagccgaccgctggctttcctctccggctgggccagcttctgggccaacgatgcgccgtcattgtcgattatggcgctggcgattgtcagcaatcttggctttttaacgcctatcgatccgttgctcggtaaatttatcgccgccggattaattatcgcctttatgttgctacacctgcgctccgttgaaggcggcgcagcgtttcagacgctaattaccatcgccaaaattatcccgttcactatcgtcattggccttgggatcttctggtttaaagcggagaattttgccgcccctaccaccactgcgattggcgcaacgggcagctttatggcgctgctggcggggatctctgccaccagttggtcgtataccggcatggcctctatctgttatatgaccggcgaaattaaaaaccccggaaaaaccatgccacgagcgctgattggttcctgtctgctggttctggtgctctacaccctgctggcgctggtgatttccggcctgatgcccttcgacaaactcgccaattctgaaacgccgatttccgacgccctgacctggatccccgcactcggcagcaccgctgggatctttgttgccatcacggcgatgatcgtcattcttggttcgctttccagctgcgtgatgtaccagccgcggctggaatacgcgatggcgaaagacaacctgttctttaaatgcttcggccatgtgcatccgaaatacaacacgccggatgtctccatcatcctgcaaggggcgctggggatcttcttcatcttcgtttccgatctcaccagcctgctgggttatttcaccctggtgatgtgtttcaaaaataccctcaccttcggctccatcatctggtgtcgtaaacgcgacgattacaaaccgctgtggcgtactccggctttcgggctgatgaccaccctcgccattgcgtcaagcctcattctggtcgcctcaacctttgtctgggcaccgattcccggccttatctgcgccgtcatcgttattgctactggtctgcctgcttacgccttctgggcgaagcgtagccgccagctcaacgctttgtcgtaatgttatctggagaaaataaaatgttggatattgataaaagcaccgtggactttctggtcaccgaaaatatggttcaggaagtggaaaaagttctcagccatgacgttccgctggtgcacgccatcgtggaagagatggtgaagcgcgacattgatcgtatttatttcgttgcctgcggatcgccactcaacgcggcgcaaacggcgaaacatctggcggatcgcttttccgatcttcaggtctacgccatttccggctgggagttctgcgataacaccccgtatcgcctcgacgatcgttgcgcagtaattggcgtttctgactacggtaaaaccgaagaggtaatcaaagcgctggagctgggccgggcctgcggcgcactcactgcggcgttcaccaaacgcgcggatagcccgattacctcggcggcggaatttagcattgattatcaggccgactgtatctgggaaattcacctgctgctctgctacagcgtggtgctggagatgatcacccgcctcgcgccgaacgcggaaatcggcaagatcaaaaacgatctcaagcagttgccgaatgcgctcggtcatctggtacgcacctgggaagaaaaaggccgccagcttggtgaactggccagccagtggccgatgatttataccgttgctgcgggtccgctgcgtccgctgggttacaaagaaggcattgtaacgctgatggaatttacctggacgcacggctgcgtgattgagagcggagagttccgccatggcccgctggagattgtcgaaccgggcgttccgttcctgttcctgctcggcaatgatgaaagtcgccacaccaccgaacgcgccattaactttgttaaacagcgtactgacaacgtgatcgtcatcgattacgccgaaatttcgcaagggctgcacccgtggctggcaccgttcctgatgttcgtgccaatggagtggctctgctactacctgtctatttacaaagatcacaacccggatgaacgccgctattacggtggtctggtggaatattaatccctctcccggcccggcaacgggccggatttacgcaaggagttacccgatgaaaacaggtatgtttacctgcggccaccagcggctgcctattgaacacgcatttcgtgatgcaagcgagctgggttacgacggcatcgaaatttggggcggtcgcccgcacgcgttcgcgccggacttaaaagcgggcggcatcaaacaaatcaaggcgctggcgcagacgtatcagatgccgattatcggctatacgccagaaaccaacggctatccgtataacatgatgctgggcgatgaacatatgcgtcgcgaaagcctcgacatgatcaagctggcgatggatatggcaaaagagatgaacgcgggttatacgctgatttccgcggcccacgcgggctatctcacgccacctaatgttatctggggacggctggcagagaacctaagcgaactgtgtgagtacgcggaaaacatcggcatggatctaatcctcgaaccgttaacgccgtatgaatcgaacgtcgtgtgtaatgctaatgatgtgcttcatgcgctggcgctggtgccttcgccgcgcctgttcagcatggtcgacatttgcgcgccgtatgtccaggcggaaccggtgatgagttatttcgacaaactgggcgataaattacgtcatctgcatattgtcgacagcgacggggccagcgacacgcattacattcctggagaaggcaaaatgccgctgcgggaactgatgcgcgatattattgagcggggctatgagggttactgtacggtggagctggtgacgatgtatatgaacgagcccagactctatgcccgccaggcgctggaacgctttcgcgcgctgctgccggaggatgagagatgaaaaccctggcgacaatcggcgataactgcgtcgatatctacccgcaactgaataaagcgttttctggcggtaatgcggtcaatgtggcggtgtactgcactcgctacggcatacagccgggatgcattacctgggtgggtgacgatgactacggcacaaagctgaagcaggatctcgcccgcatgggcgtcgatatcagccatgtccatacgaaacacggcgttaccgcacaaactcaggtggaactgcacgacaatgatcgcgtttttggcgactacaccgaaggcgtgatggccgactttgccctgagtgaagaggattacgcctggctggcgcagtatgacattgtgcacgcggcaatctggggacatgcggaagacgcattcccacagctgcacgctgcgggcaaacttaccgctttcgacttctccgacaagtgggacagcccgctctggcagacactggtgccgcatctcgattttgcctttgcctccgcaccgcaagaagacgaaacgctgcgtctgaagatgaaagcgattgttgcccgtggcgcaggaacagtgattgtcacgctgggtgaaaacggcagcattgcctgggatggcgcgcagttctggcgtcaggctcctgaaccggtgacggttatcgacaccatgggtgccggagattcgttcattgccggattcctttgcggctggtctgcggggatgacattaccgcaggcgatagcgcagggaacggcgtgcgcggcgaaaaccattcagtaccacggtgcctggtaggtataacgttggcgtgagcatcttcacgccaacgtgctgttacttgccggaaaacgaccctataatccgagtaattcattctttatttcagggtcgattatgtcagctacggaccgctactctcatcaactcctctacgctaccgtccgccagcgactgctggatgatatcgcgcagggggtttaccaggccgggcaacagatccctaccgaaaacgagctttgtacacaatataacgtcagccgcattaccattcgcaaagccatcagcgacttagtggcagacggcgtactgatccgctggcagggaaaaggcacctttgtacaaagccagaaagttgaaaacgccctgcttactgtcagtggttttaccgattttggcgtctcacaaggcaaggcgacgaaagagaaagtgatcgaacaggaacgggtcagcgccgcgccgttttgcgaaaagctgaacatccccggaaacagcgaagtgttccatctctgccgggtgatgtatctcgataaagagccgctgtttattgatagttcatggatcccgctgtcgcgttatcctgactttgatgagatttacgtcgaaggaagctccacctatcagttatttcaggagcgttttgacacgcgagtggtcagcgacaaaaagaccatcgatatctttgccgccacccgcccgcaggcaaaatggctgaaatgcgaactgggcgaaccgttgtttcgcatcagcaaaatcgcctttgatcagaatgacaaaccggtgcacgtctccgaactcttctgccgcgccaatcgcatcaccttaactattgataataaaagacattaaccgtaggccggataagatgcgccagcatcgcatccggcgatgctggcgcgttgaattttacatcccgtacgttcccctcaccctaaccctctccccaaaggggcgaggggaccgttcagtacggaatttagcttgacggtgctatccagcattaaatactggcaatactctcacgcaaaatccgcagcaccgtctcttcaccgctgcgattcgggttaatgcgaatcgcacaatgttctgattgtggattcgcctggcgaaacgttccggaaaggcgataaaagagcggcgggatttcatatttcgactctgcacccaccgggtaaggcaaggcaccgcgcttttgcgcctcttccagcactctggcggcaatcggctgatgaaactcgacaatcaacaccttcgactgcgcattagcaatcaccgcgcttttcacttccggcaccgcaccaccgttaagcaaagccagcaaccgttcagatacccctgcctgcaccgcgtgcatcactggcgcaaacaccagaccacgcaatacttccagcgcctgtgcgccctggatctggctaccgccggagtaaagcgtggcgcgaatacggttgataacatcagcatcgccgaccactgcaccaacaccctctggcccaaatagcttgaagcaggaaaatgtcgagacattcgcgccgcattcacagccgattcgagccaccttcatcaccgcatagttgtcatcggttaacgctggaacacctgccgcgcgcaacgttgccagcacatctgccagcacgtagctgtcctgcggctgctggcgcgtatgctgcaccagcgccgcatccggttgttgctcgtcgacgacctgcttcagtgccgacaggtcattgaaatcaacagtaataagcgtcagccccatctgctcaataataacccgtgtcgtcgggtaaacaggcgcgtcatgcaccagaagacgctgccccggtttgagcaaagccgccagcccggcgcgaatcgcgccagtccccgcgccctgcaccagcgccgcagcctgtgcgtgaaatgcatcagccagcacctgttccacacgctgggtaacgcgcggttgattcagtcctggcgttaagcctaaatcaccgccagtaagaaactcgctgccggggaaatggcgacaaatgctatccaccagcgcaaactgcttttgctgcgcctcaataatcgtcaggctttgcagaggaaacgtcttcataggtgccttccttaagccggaacgaacaggccaagccagtaaagaacattcagcagaataccggtgatcattactgccacgaccggtgccgccattttctgtaccggacggcccagggattcgttgaggaagtaaatggcaaccgcgatagagaatccggtataacccgccatcttaattgctgcgaaaatcgaaccgaccagcagcgccacttccatcagcatattcatggcgttacggatgttatccgacgcattacgcaccgacgggtagcgtcccagccatttgccgatcgaacgaagcagcaagacttccgccgaaataaccactgcgcctaataccgctgcaaccatcggattcggcgagagatagtccaccgcataaacaaaggtaaagcccgcaactgcatacacacccgttgctaacgcggtggtggcaatcaacggcacaaaccccagtccgcgcataaattctgccagagccgcctgattaatcagcgtttgcgattgttccggcgttacgcctgcggaatatgctttctccagtgtgaagatcgacacttcactgccagcaaaaatcttcatgctggcaacggcggcaatcaatgctcccacgatggcgatatagggtaagtttttgataatccgtgacgtgcgttcttcaaacaccgaaagcccgctggcatcaatgtcattttcatcacgatgacgcaggtcgtgagttatcgcgatccccagcagcatcaccatgccaataaagatttcgatggattcagggttaagatgtgggaaatagcgcacgactaccacacgggtcatcagtaccaccacggcggcgatcagactttgcttccagccaaactggtagaaaatcgccaccagcgggaacagtgcaaaagctgaaaccaccggcgagcttaattcccccaggctacctaatacatccaccggcagcgcggtcagcagctggtttactggcaacaggcaagtaaggatcaacacgccccagatagcgccaagaccaaacgccatcaggctgtttatcgccaggacgccgaggatatcggtaggaagaaagagtaaccatgcgttgagcagcccggttttcagggtaaaagagatccccaccgaggccacaaaaccaatgctcagaccaaaagcgatactccccgcctcgcgacggttcatatagccttcaatcagttgcggcaggatcgggcggatgccgtcatgaaaaacagccgccgagcgatgcgccagaagcgatgtcatacccgtcaggcacgccaccacgataatctgaatatacagatccatagtcgtgccttttatttcagatggttaatcagcatcggaatcgcgtgttcgacgtgctcaacggaaaggccaaacgccacttttccttcagcgatcattttggcgatatgctcgtctttcgctttaatgcctggtttggcaatggtgcaacttttgttatagcctatcaccgcgatggcaatcgacaatgccgcgcccgcaccggtattacacgcgccgatgtaataatccagttgcccggatttcaccttcattgccgcttccatgtcgttgtgaatgaaaacttcaaaacagccaggagccgtcgcttcaatagtttttttaatctgctcacgctgtaagcctgcaacgccaatctttttcatgagtctgtccttattggaaaaattgagagggattttcacgtaacatcacatccacatcggcctgactgaatcctgactggcgcaattgcggaataaaggtggttagtaaatagtcatagccataaccaccgttggcttttaaatgggagcggcgcgtaatatccatcgacagcatgacgcggttcagcaacccacggtcgcgtagcgcatgaagcatcgcaatacgcttttcgtccgggtagtaactgttcttgccgatggtgtcgaactgcacgtacgcgccgagatcgatcatcttcaaaatgttgtcgaggttgtctttcagatcgcagtgaccaacggtgacgcgcgaaagatcaaccccgtgggcttgtagcaacgccagttgctccagccccatcgtgctgaacgacgtatgcgtggagatcgggcgtccggtctggttatgcgccagcgcagcggcaataaataccttctcttccagcggcgtaatctttccttcgctggtgccgatctccgcgatgatcccggctttcagctccgtgccatcgataccctgttcaatttcatcgaccatctcctgcgccagttcctgcacgctgcgggtcgccacatgttccgggaaaaacgcgtcctggtaataaccggtacaggccaccacgttgatccccgtctcgcgcattacatcaagcataaattgcgcattgcgccccatgtaacggttggtcatctcaatcacattacgcacgccccgggtcatcaggtcgttcatctcctggcaaatgaacgcatactgatcaaggcggcagtccacgttgtttttaaagccggagagatcaatatgcagatgctcatgggcgagggtgtaacccgtcggatcaaaactcatagggtgtctcctgcaaaccggagggaggaaagaaaagagcgaccattttgtggcggtggcgcgcggaaaaattcacacacggtagcccccacatcagaaagcgtggtgcgcacaccgagctgcgtagcgatcatcccttgctgataaaccagcactggcaccacttcgcgggtatggtggctgtgaccaatggtcggatcgttgccgtgatccgccatcacgaccaggcaatcatctggctgcatcgcctcaacaagccgggcaaggttacggtcaacgacctgcaaacgttcggcataacgtgcgacgtcttctgcatgaccagcgaggtcggtttcctgaatgttggtgcaaataaacgccgtcggatgggtgttaaattcgttgagggtgatatccataatccgctggctatccaccagattttgccagctcacgccataaggattgttgacgatatctgccaccttacccaccagcacggttggcacgcctgcttcatacagtttttgtggcacctgcactttttcatcgacgccatagcccatatgcacgacctggaaaccgttgtcataagcgccagaacgcggcgcattgataccaataaagcgcccttctttgctttctgcggcatcgagaatgcgttgactgtcggttaacaggccaccaaatgtaatgacccgaccgacctgtacctgctcacgcacgatacgaccaattttgattgcgtcgtcaaaagagatcacagagagattggcggtaatgttatagacctggcctaaatccgcctcgagattatcgccaatcgcaaccgcctgattgacccacagaaattgcagatcatcgccacggcgctccacctgccagccagcggaaactaatgcctgctcaacacggtcaatcacatcgcgaaaaggcatccgcagcggcggtaacgggcgcgtgcctaaaatttcctgatgccccataaaggtatcgccaccttcatgttgcagctctgccacgccccaggttgcggaatctgacggctgcatatcgcctggcgcataacccaatgcgttgattagccccagcgtctccagcgttggtagctgcaaatgcggcaactggctcaggatgtgaccacatgtattcgctcccgcatcttgcggacgcaccagcgtgacatctttcattgcccctacgccaaagctatcaatcactaacaccacaaatcgcgccattacgcccccagagagtttccaagactgtcataacgaccgacgatttccggttcgccacgatgaataccggacaccagcaccacatcgctacgggtgacaaaaatctgcgtgcgaaaacagagcaccactgcactgcttaccggaaactcgcctgccagcggcagggtgtagtcgatactgctgtcatccacagttttgagattggtttcagtaatcttttgattttctggcgtaaacaccaacgcatgttgcgcatgaccacgacgatagtaaccgccgccgtagcagtagctgtcgccacggaaatgatgggagatttcacttaaccagagcatcgcgatacgttcaggctgatcgccctgctggtttgccggaatagtgcccgtcagcgcatgaccgggttcggcatgagtcacaccgtattgcgccagtaatggcagcgaagtgcagctggtcgctgaaggcgcgttcagttgctcaagtgcaataccagatttcgccagttgatcccgtgcctgtatcagcgtgtgaagattcggtgtcggcaaaacttttccgacagcctcatcccaaagcaggcaagggaaatgggtaagtccggctaaatgcagccctggcagattctggatttcggcgacaatctccggcaacaccttgagggcaaaaccgctctcctggcccggataaagaaaatcatcgtcgctataaactttaagcagcacagactggattcgcccggccttcaccgccgccgcagaaacttcccgcgctttgtcgagagtaaacacggtgatgacgtcggtgccctgttcaacggcgtcagcaacctgatgacaagggatttgtaccagatgcccctgatgcgccacaggcaaaccagcgcggcgcatgactcgcgcctctttgtaatccaccgccacaatgccgctgtagcctaatgccagcaatttttccgccagccacggattacgaccaaactgcttggtcatcagatacagttcaatgccgtaaagccgcgccgtctcaatcagccgcttaccgttttccagtatctgatccacgtcgatcacccagctgtccggggcgatcttgccctgctgccacaggcttagtgcggcggaaatcagcgccgggttctggcgtttcaatgcttctacaaacatcttgttgcctcgtttctgttccttgaattaaatattcatttttttgaatatttaggttgtgcgacgtggatttgtcgggagcttcaaacctcttcgttagcagccatccataatccataaaggttggccagcaaatagccttcttcacacgggttaacttccagtgcgaattccttcaacaacacctgatgcaattgcacaacggcttgccagtggctggattgcgccagttctgccagcaactcgttatccagcggctctatttcttcaccacggcgactgcgcatcagtgcactcgccatatgtgtcatcgccatcgttccttgctcactgcgcaccggcagatggcactctgtttccagtacgttgacgacctgcatcatgcctttgcagatgtccttatcaataacgcctgcctcgcaaagcaggttgagtctggtttccatatcagatgcctttcgtttaataactcggttcctgttccccactcactacccgttgttgatgggcgagcagggcgtgtttatctacaacggcacgcagcagttgttgcattgggtaatcatcgactcgcgtcaggaccacggcttcggtggcctgtaaaaatcgcggatcgtctgtgagcggcgtcgcctctaatcccagcatggtcagttcgttttccgccaccacgttccagatcaccgcatcgacatcgcctttaacaatgcgttgtaaactctcgtgataagagagatcgactcgttccacatcactaccgccaaaaaaaacatcggtcatgattttctgatccgccgaacggttatccagccccacgcgcttcacgtttgcggactcgcctttacggcaaatcaactggtgctcgccaacgtaggtgtgcggccccaactccagcgcgaggcataagcctttttgcgtgagataactttccgccgctagtcgcgaaaccaccgccatgtcatacacgccattaagcagacactccacgcgaatatccgcgccacgcatgtgcgcatagtaaaaaggaatgccatcaaactgggctttcaatccgctcgccaggccttcgtacaaacgggtatagggcaagggcattgcacataccacgttgttgatatccacatgagtcagcaatgctttgttatccatctcgaccagataactgccattgcgcccacggcgttcaatccgtatcgctccgcttgattccagcgttttcaacgcggcctgcgtcaggccaacggatgaacggcattcatttgccagctcatctatggttttcaatcgattaccgcacttttcacccaacaaataacgggccagcgtcgtgatgacgacgccttcttttttgataaacgttcgacgcataataaattttcagtaaattgaatatttatatcttcaggaatttgaagataaggcgcaacagcgagatgtggaaacggcgaggcacttcacattttttcggattattgcaaatgaggataaaaaaaccgggtttccccggtttcagagtgatgataaaagcaaaattgcctgatgcgctacgcttatcaggcctacatttccttgcaatatgtgcattactttgtaggccggataaggcgttcacgccgcatccggcatgaacaaagcgcaatttgccagcaatagtgaattacggcttcgccacaaaaccaatcgcttcgtacaccgcttttagcgtacgggaagcgtgcgcgctggctttttccgcgccatctttcatcacctgttgcaggaaggcttcatcgttgcggaaacggtgatagcgttcctgcaattcagtcagcataccggaaacggcatcagccacttcacctttcagatgaccatacatcttgccttcgaactgtttttccagttctgggatgctctggcccgttaccgctgaaaggatatccaacaggttggaaacgcccgctttgttctgcacatcgtagcgaactaccggcggctcgtcggagtcagtgaccgcacgtttgattttcttcactaccgatttcggatcttccagcaggccgataacgttattgcgattatcgtcagacttggacatcttcttggtcggctccagcagcgacattacgcgcgcgccagatttcggaataaacggctccggcaccttaaagatctcgccatacagcgcgttgaaacgctgggcaatatcgcggctcagttcgaggtgctgtttctggtcttcacccaccggtaccagattagtttgatacagcaggatgtccgctgccatcagcaccggatagtcaaacagaccagcgttgatgttctcggcataacgcgcagatttatctttaaactgcgtcatgcgactcagttcgccgaagtaggtatagcagttcagtgcccagcctaactgtgcatgttccggcacgtgggactgaacaaaaatggtgcttttctcaggatcgataccacaagccagatacaaggccagcgtatccagcgtcgctttacgcagcttctgtgcatcctggcgcacggtgatcgcgtgttggtcaacgatacagtaaatgcaatggtagtcatcctgcatgtttacccactgacgcagcgcacccatgtagttaccaatggtcaattcacctgagggctgtgcgccactaaaaacgatgggcttagtcatttttcgattcctgattttcgctatgcggaagccctaatgcgggcagaaggtcatttatagactgataaattacatcaggctggctgagatcgatagcctcgccgtagttatatccgtaggttaagccaactgatgggcaacctgccgcttttgccgcctgaatatcattgcgtgagtcgccgacaaacagcatctgttgtggggcaattcccatccgctcagccaccagtaacagcgggtccggatgcggttttttgttttgcacatcatcaccaccaatcaccacgctgaagtatttggcgatatctaaggcttcgagcagcggcgcgacgaacggcgtcggtttgttggtgaccaggcctagcggcaggcctttagcctgcaacgcgcccaacgtatcggcaacgtgcgggaacaaaaacgtcccctcttcggcaacctcgccatagtagcgatcgaacagtttacgcagaatacgtacctgttcttctgccggaatgtcgtcatcaacgggcggtttacccattgttttacgctgagtcgcacgttcctgacgcgcccaggtcaatgcgcgctccatcagaacatctgcgccgttaccaatccaggtaataacgcgttcttcacctgcgacgggcaactccagcgcatacagcgccatatctaccgcagcagcaagaccaggagcactgtcgaccagcgtaccatcaagatcaaaagcgacgccgcgaatatcttcaaacttattcatgacttacctttgccagttcactgcgcatttcatcaatgacttttttgtagtctggctggtcgaagattgccgaaccggcgacgaacatatccgcgcccgccgcagcgatttcgccaatgttgttcaccttcacgccaccgtccacttctagtcgaatgtcaaagccagactcgtcgatacggcgacgtacttcgcgcagtttatccagtgtttgaggaatgaaagactgaccgccgaaaccagggttgacggacatcagcaggatcacatccagcttatccatcacgtaatccagatagctcagaggtgtcgccgggttaaataccagacccgctttacagccattttctttaatcagttgcagcgtgcggtcaacatgctcggaggcttctggatgaaaggtaatgatgctggcaccagcggcagcgaaatcaggcacaatgcgatcgacgggtttcaccatcaggtgtacgtcgataggggcggtaatgccatagttacgcaaggatttcagcaccattggcccaatcgtcagattgggaacatagtggttatccatgacgtcaaaatgcacgacatcagcgccagctgccagggcttttgcggtatcttcacccaggcgggcaaaatcagccgacagaattgagggggcaatcaaatactgtttcatccgcttctccttgagaattattttttcgcgggtgaaacgactcctggtttgtacaaagccagcagttcgtccacctttttacgtgtgccgccgttgctgcttatactgcgtcgaactttgacgacatgcaattttgcgcgctgataccactcacgcgttaacatcgtatcgtgattggagatcagcactggaatatggcgctcaaccagaccttcggcgatctccgccagatgcgcttgttgttcaagcgtaaaactgtttgtgtgatacgccgtaaagttggcggtcgcagacagcggtgcataaggcggatcgcaatagacgacggatgcatcatctgcgcgcgccatgctatcggcgtaagactcacaatagaaaaaggcattctgcgctttttcagcgaagtgatacaactctgcttccgggaaatagggttttttgtagcggccgaacggcacgttaaactcaccgcgcagattgtaacgacacaggccgttgtaaccgtagcggttcaaatataaaaacagtaccgcccgacggaacggatcctggcttttgttgaactcttcgcggaactgatagtaaacctcggcgcaatttgtttcgggaacaaacagctcgcgtgcggcctgtacgtactcatcagtacgcatcttcacaatgttatagagactgatcaggtcgctattgatatcggcaaggatataacgagaaaagtcggtgttgagaaacaccgacccggcacctacaaaaggctcaaccagacattcgcccttgggcaaatgccgtttaatatcatcaagcaggggatacttgccccctgcccacttcaaaaaagcgcgatttttcttcatgctgactaactaattacaccttctccggctgtggagaaagctccgacagcatccagcgcttcaggcaactcccgcaacgataaaccattgcgggagataaccttgattacttcagatcggcctgtacctgacgcagcggtttcgcccacgggtttttggcctggacatctgctggcaatgtagataccgcttttttcgcctcttctttcgaagcgtacacgccagaaaccaggacataccacggctgaccattacgcgtcgtttcatagacaacgtagtttttcagattctctttcttcgcccaaccgttcaggttgtcgtagttagaggaactgctcagctgcagagtgtaatggctggacggtgccgatttcaacgaaccaacattacctgcggtcttcgccccagcagcgggtgttgctgtggtttgcgccggggatgccgtctgtactggagccgtagtcgccgtctcttttggtgctggcgtagaagtcgcagccggtgccttcgtgctcgccacaggggcagctggttcagtacgcttcggcgtctgtgctaccggcttcggctccgttttcacggttgcttgcggttttttcggttcaatcaccgcctgctgacgagctgggcgcgtagtggacggacgttcagcggtttgcgttttcgccgtgtcacgcgatgcattgccattgcgaacaggcgcaaccgttgcgggttcagtcggcaacgtggaattgaccgccacattgttcagctgttgctgattttgtggctgggtcagcgcattgttcaggtcaccctgcacttcaacacgttgttgaccatccgttgccaccggggtttgcccttgagtcggcgtagaagagatcggtggcagagaaacatcctgctgagtattttccgcagacgtggttcccggcgctggctgcacgccattcgcctgatcggtcgcattgccagcaagatcaatactcttctcgccagacgcggtttgatcgctggaagtggtcgagggggcttttagcgcagaaccgataccgatgatcaacagcagtagaaccagaatgccgacgcccatcatcatatactgacgagaagcgggtttactggctgcttttttgcgcttacgcggacgacgctctacgcgctcttcatccacggtttcatcttcggattcgtcaatttcttcttcgatttccggttcctcattgcgctctttttgcgcacgagtcggacggcgatcgtcagtgtcatcaagttcaatatcatcaaaattgatctgcggttcgccacgttcagtacgctcagaacgttcagaagattgacgagaacgaccagtacgacgatcgctgggatcgggtttcagctcgtcttctggtttgaattcatccatttaacaccccactaaaaggttaatgcttaccacgttgcaattaacctgaagctaatagaccgcttgataagcggcctgacctttcttgttgttacgctgattgacaatcggcaatggcgttaagaacaagctcgtgcgaaacgccgctgcgaacttcactcttaccaattgccaacggaagaattaagcgcatctctcccgcaaggactttcttgtcacgcagcatatgcggtaaatacgcctgcgcggacatttcgcgcggcccattgaccggtaacccagcccgcttgagcagggttataatacgctgcgtttcggcagaactaaactgcccgagacgttccgacgtccgcgccgccatcaccatacccgcagcgaccgcttcaccatgtaaccaattgccataccccatttcagcttcaatggcatgaccaaaggtgtgtcccagattcagtaaagcacgtaacccggtttcgcgctcgtcggcggcgacaacttctgccttcagttcacaacaacggcgaatacagtacgccattgccggaccgtccagacgcaacaacgcatccagattctcttccagccagttaaaaaacgcaccgtcaagaataatgccgtatttgatgacttctgccagccccgacgctaactcacgcgggggaagcgttttcagacagtcgagatccaccaccactgaagcaggttggtagaacgcgccaatcatgtttttaccgaggggatggttgaccgcagttttgccgccaacggaggaatcgacctgcgacagtaacgtcgtcgggacttgaatgaaacggacaccgcgctgataactcgccgccgcgaagccggtcagatcgcccactacgccgccgccaagcgccaccagcgtagtatcgcgaccatgcggtttttgtaacaacgccgtaaagacggtatcgagtacagccaggcttttatactgctcgccgtcagggaggataacgctatcgacgttaacacccgcctgttcaagtacgccgcggaccttatcgagatacagaggagccagggtttcgttggtgaccaacatgacctgctcgcccgatttcagcggtaagaatgaagctggttcattaaacaaaccagatgcgatggtaattgggtaactacgttccccgagagtaacgacaatcctctccataacgcgacatccaccttaattactgtacccgcagacgagtgtatataaagccagaattagttgctttccagcatgtgaataatctggtttgcaaccactttagcgctttgatcatcagtacgaatggtcacgtcggcaatctcttcatacagcggattgcgttcattggccaacgcttccagaacttcacgcggcggtgtttcaacgtgcagcaacgggcgttttttatcacgctgcgtgcgtgcaagttgcttttcgatggtcgtttcaagataaacgacaacgccacgagcggaaagacggttacgcgtttcacgggatttcacagagccgccgccagtagccagcacaataccctgtttctcggtcaactcattgatgaccttttcttcgcgatcgcggaagccttcttcgccttctaaatcgaaaacccagcccacatcagctccggttcgtttctcaatctcttgatcggaatcgtaaaattccatattgagttgttgagctaactggcgcccaatagtgctttttccggcacccataggcccaaccagaaagatattgcgtttctctgccattttttcggtactactaagactattcgttaatgataaacccgcttcgctcagagagcgccgcaggacatgaactgaaacctcataagatattgcgagagtcagactgaaaattatctcaatactccagcgggtttggcaactgaataaatcacccatccctctgcatatctggtcgctgcaagcgcgctgccttgctaccaccgctctggcgataaatcaccgggtaagattagcgtaaaaaagacagcaaaatgccgcctgaatgataaatcatcatcatggaacgcaggcagcgaagagcaccaactctcaaatcggtactccttgtatgctaaatacctgcgcgcgtcaaatagatgaaacacgttcagcgtaaaaacattaccgcttttacggctgtttactcactggaaaccagtcgtggcgtgataaacaccactaactcgcgtcgttcatcttcttttccgtcatgacgaaataattgcccgaaccagggaatgtcgccaagcaacggtacgctatcctgacccgatttatttttacgggtaaaaatgccgcccagcgccaacgtttctccgcttttgacctcgacctgcgtttcgatctcctgcttatcaatcgccagcacttcgccatcggcctgctgtagcacctgccccggaacgttctggctgatgtgtaatttcagccggatgcgacctttttgtaacaccgtgggcgtgacctccatccccaggacggcctctttaaattccaccgacgtcgcgccactttccccgctggaaacctgatatggaatttcgctcccctgtttaatgctggcaggctgaagatgtgaggccagcagacgcggactggcgataatatccagctgctgtttttgttcgagcgcggaaagctcaagatccagcaagcgtccgttgatgcgcccaatgttaaaaccgacatgcgttgtcgccgtcgctacggagaggtcgctaccaagcgtggtgacttgcccaacgccaccagcgtgttgcgcatcggccagcgtccatttcacgcctaactcacgcaaacttttttcattaatggtgacaatatgcgccgacagctcaacctgcccgaccggcagatccatttgcgctacccactgttcaagcgcgcttaacgccgttttgttatctcgtagcaaaaggcgattggtgcgtttatcgacggtcatactccctttggcactcagtagcttctcccccgctttcgccagttctcccgcgtcggcgtattgcagggttatactgcgattttccagcggcagatttgcctgcgcccgcgcctgctccgcctcctggcgggcgatattgttattctgccaggcaatggaatgcactgagagaatgttgccttcctgccgcgttatcagtccggcgcttttcactacagtttgtagtgcctgcttccagggaacatctgttagatgtaacgacaccgtaccgctgacgtctggcgacacgaccaggttcaacttctcctgttcagccagcgcctgcaacacctgagctaccggaacgtcatccaccatcagcgtcactttttgcggctttgccgcctgtacgccgggtatcagcatcaacagtagtgcggctatccattgcttcatttgtatctccttgccgttgccacaaccattgtggcggttcgcagtttgtcccggtacccagcgttagtacgtctggcgtcagctgtaaaattgtccagccgttttccagcacatcgttttgctgcacccgtcgccatttcttttgcccgtcttttattacaccgatgatgcgctcgcctcgccctaccatcccctgatagcgccactggctaagttcgctaatccggcatagatcttccggcggtttaaaagggtcacgcataccggttaaaaggcacaatgcaatacctgccaacaaccagcgtttaaccctcatgcggcgtctccagttgtagcgtgaacaaaagatcatcaccttccacgcttaacgaaaaacggctcacgctgacgttgcgctctgccagccgtgtaaatgccgacggcactgcttcccacagcgttttcaacgccaactcgcctccctgcgcggatggatgccaggaaaccagttgcgcgccggataactgaaaatccagtggcgaaaagggcagcgttttttcctcgctgaagggagcggtgtctaccaggcgatacagtgcggcccactgctggtgatgacttgcccgtagtcgaattaatgcgtcgcgctcttcatggtgtgtcgatgacagaaaaatgagcgtaactaacatcagcaaccagaatgcccagcaaagctggcggaggcggggtgatgtggcgaaccaccagtcaaagaacatgttcatcgctaaccttccttgttaactgatactcaaattgccagcgtccctgcgcatcctgctgcgtggctccccgctgattgagatgaaaagatgcatcctggcggagtgacgtttctagtgcgtttaacgcggtaatgcttgttgtcagccccttgatctccagcgttccctgctgccagcttatcgttgtcagccaggcgtgctcgggtaaaagcgccgccagtgcttccagcgcagattgccagtcgcgggtaaattgtcgctggcgctgccgttgcgaacgctgttcgcgtaactgctgttgctccagcaaacgtggcttcgttatctgtaagctgcgggcgagttgttgttccgcctgaagcaaaactgcgtctatgcgcgcttcggcgctgcctgtcagacgcagtattagcgttatcccgacggccagcagcagaggcgcaacgaacatcagcaaccagaaacgcagaaaagcggtccggcgttgctgtcgccagggcaaaaaattaattggcgggttcatcagtacgccttcccaagcgccagccccagcgcgatggcaaagtctccacctggcggcggtagcggcggctgacgaacagaaacggcctcccagggatcaaatccgccttcgccacatatcgcgacgctttcgggatcaacggataacgctgccgccagctccttcgcgctagtcatccccaccgccagtttgcgcccccagctatagcgcgtcgcccacagccactgttcgttatcacgccaggccagacattgctgatgagaaggtaaaaaaggcaggaatcgctgtaatgcactggcatccggggtgatcgcgctcacatgaacacgcaacctttctgccagagtaagcagcgttgccagctctttgctttgcgcggcagtcacgttataggcgggactgagtgagtcttcgctgtaatcgaagcgcagggagtccggatccatatccagctcgcgggccatcgtccctgacagccaggccgtttgctcccgctcaccaagggacatcgacgggcgcggaaatgaccgctgtaatgtgcgactggcgggaaacgccaacataatgtgatgacgctgcggcagttcgcgactccacggtaacaacgttttagccagctgctgcgcatcaacaatccgcccatctttgataatgtcgttctccagcggcaaccgccaccagcgttgcaaaaagcattcttttgcgccccgcacgatcgcaaccgctaccgcttcttgctgttgtaaatgcaaaccaatttgccagatcttaaatgccattgtgatgatctccttatcacccgtcactctgacgggtatatcaatgcgtctggcttgcctttatactaccgcgcgtttgtttataaactgcccaaatgaaactaaatgggaaatttccagtgaagttcgtaaagtattttttgatccttgcagtctgttgcattctgctgggagcaggctcgatttatggcctataccgctacatcgagccacaactgccggatgtggcgacattaaaagatgttcgcctgcaaattccgatgcagatttacagcgccgatggcgagctgattgctcaatacggtgagaaacgtcgtattccggttacgttggatcaaatcccaccggagatggtgaaagcctttatcgcgacagaagacagccgcttctacgagcatcacggcgttgacccggtggggatcttccgtgcagcaagcgtggcgctgttctccggtcacgcgtcacaaggggcaagtaccattacccagcagctggcgagaaacttcttcctcagtccagaacgcacgctgatgcgtaagattaaggaagtcttcctcgcgattcgcattgaacagctgctgacgaaagacgagatcctcgagctttatctgaacaagatttaccttggttaccgcgcctatggtgtcggtgctgcggcacaagtctatttcggaaaaacggtcgaccaactgacgctgaacgaaatggcggtgatagccgggctgccgaaagcgccttccaccttcaacccgctctactcgatggatcgtgccgtcgcgcggcgtaacgtcgtgctgtcgcggatgctggatgaagggtatatcacccaacaacagttcgatcagacacgcactgaggcgattaacgctaactatcacgcgccggagattgctttctctgcgccgtacctgagcgaaatggtgcgccaggagatgtataaccgttatggcgaaagtgcctatgaagacggttatcgcatttacaccaccatcacccgcaaagtgcagcaggccgcgcagcaggcggtacgtaataacgtgctggactacgacatgcgccacggctatcgcggcccggcaaatgtgctgtggaaagtgggcgagtcggcgtgggataacaacaagattaccgatacgctgaaggcgctgccaacctatggtccgctgctgcctgccgcagtcaccagcgccaatcctcagcaagcgacggcgatgctggcggacgggtcgaccgtcgcattgagtatggaaggcgttcgctgggcgcgtccttaccgttcggatactcagcaaggaccgacgccgcgtaaagtgaccgatgttctgcaaacgggtcagcaaatctgggttcgtcaggttggcgatgcatggtggctggcacaagtgccggaagtgaactcggcgctggtgtcgatcaatccgcaaaacggtgccgttatggcgctggtcggtggctttgatttcaatcagagcaagtttaaccgcgccacccaggcactgcgtcaggtgggttccaacatcaaaccgttcctctacaccgcggcgatggataaaggtctgacgctggcaagtatgttgaacgatgtgccaatttctcgctgggatgcaagtgccggttctgactggcagccgaagaactcaccaccgcagtatgctggtccaattcgcttacgtcaggggctgggtcagtcgaaaaacgtggtgatggtacgcgcaatgcgggcgatgggcgtcgactacgctgcagaatatctgcaacgcttcggcttcccggcacaaaacattgtccacaccgaatcgctggcgctgggttcagcgtccttcaccccaatgcaggtggcgcgcggctacgcggtcatggcgaacggcggcttcctggtggacccgtggtttatcagcaaaattgaaaacgatcagggcggcgtgattttcgaagcgaaaccgaaagtagcctgcccggaatgcgatattccggtgatttacggtgatacgcagaaatcgaacgtgctggaaaataacgatgttgaagatgtcgctatctcccgcgagcagcagaatgtttctgtaccaatgccgcagctggagcaggcaaatcaggcgttagtggcgaagactggcgcgcaggagtacgcaccgcacgtcatcaacactccgctggcattcctgattaagagtgctttgaacaccaatatctttggtgagccaggctggcagggtactggctggcgtgcaggtcgtgatttgcagcgtcgcgatatcggcgggaaaaccgggaccactaacagttcgaaagatgcgtggttctcgggttacggtccgggcgttgtgacctcggtctggattggctttgatgatcaccgtcgtaatctcggtcatacaacggcttccggagcgattaaagatcagatctcaggttacgaaggcggtgccaagagtgcccagcctgcatgggacgcttatatgaaagccgttcttgaaggtgtgccggagcagccgctgacgccgccaccgggtattgtgacggtgaatatcgatcgcagcaccgggcagttagctaatggtggcaacagccgcgaagagtatttcatcgaaggtacgcagccgacacaacaggcagtgcacgaggtgggaacgaccattatcgataatggcgaggcacaggaattgttctgattaaaaaggcgcttcggcgccttttcagtttgctgacaaagtgcacttgtttatgccggatacggcgtgaacgcgttatccggctaacaaaatcgtgaaaactcaataaattgcagaaaccccataagcctgataaacattgtgcatcaggcaaacttcacgcatttacactcgcccctgccctttcaaccattcgcgcacgaggaacagcgcactgacattgcgcgcttcattgaagtcagggtcttccagcaaatccatcatatgcgccagcggccagcgcacctgtggtagcggctctggctcatcgccttccagtgattccgggtagagatcttgcgctaccacgatattcattttgctggaaaagtaagacggtgccatgctgagcttcttcaaaaaagtcagatcgttcgctccaaatccaacctcttcttttagctcgcggttagcggcttcgtagacgctttcacccggatcaattaatcctttcgaaaaacctaattcgtaggattcagttcccactgcgtattcgcggatcaggatcaggtgatcgtccacaatcggcacaatcatcactgcttcccggttggttggacgcattcgttcataaacacgccgcacgccattgctgaactccagatccacgctctcgacggtaaacagtcgggaacgggctacagtttcaacattcagaatggtgggtttttgtaatgatttgctcatcgtgggatctatgctgtgaaatcagcggttattgtgcgatatcggacacgctttcggcaatgtgaattgcatgttatttacatttatgtaacttaataaataatcgtcctcaaatcaaattaaaagtcaataggttgaaataactccaggaatttgctgatattccgccttcagagggtttgctatgatcagcggttactgtgatgtgcttaatgatgctcaagttaaactccacgcttgccgatagccaaccgcagaatcatgtattgtgtccggtgcgactgaccacgcctgacagactaagtaagatggggaaagcatgagcaccattgtgatttttttagctgctttgctggcctgctcactacttgcgggatggctgataaaagtgcgatccagacggcgtcagctgccctggaccaacgccttcgcggatgcgcaaacgcgtaaactcacacctgaagaacgtagcgccgttgaaaattatcttgagagcctgacgcaggtattacaggtgcctggcccaacgggagccagcgcggcaccgatctctctggcgctgaatgccgaaagcaacaacgtcatgatgctgacacacgctatcacgcgttacggcatctctaccgacgatccgaataaatggcgttactacctcgattcggtagaagtccacctgccccctttctgggaacagtacatcaacgatgagaataccgttgaactgattcataccgattcgctgccgctggttatttcactcaacggtcatacgctgcaggagtacatgcaggaaactcgcagctatgccttgcaacctgttccgtcaacgcaggcgtcgattcgcggggaagagagtgagcaaatcgagctactcaatattcgcaaagaaacgcatgaagaatatgcgctgagtcgtccgcgcgggctgcgtgaagcgttgctgatcgtcgcctccttcctgatgttctttttctgcctgattaccccggatgtatttgttccgtggctggcaggcggcgcgttactgctgctgggcgcaggtctgtgggggctattcgcgcccccggcaaaatcctccctgcgggaaattcattgtctgcgcggtacaccccgtcgttggggattgtttggcgaaaacgatcaggaacagatcaacaatatttcactcggtattatcgacctggtctatcccgcacactggcagccatacattgctcaggatctcggtcaacaaaccgatatcgatatctatctcgaccgccatgtagtgcgtcagggacgatatctttcgctgcatgatgaagtaaaaaactttccgttacagcactggctgcgcagtacgattatcgctgcgggctcgctgctggtgctgtttatgctgttattctggatcccgctggatatgccgctgaaattcactctctcatggatgaaaggcgcgcagaccattgaagccaccagcgtaaaacaactggctgacgctggcgtgcgggtaggcgatacattgcgtattagcggtacgggaatgtgtaatattcgaacttccggaacctggagcgcgaaaaccaattcaccttttttaccgtttgactgctcgcagatcatctggaacgacgcccgctcattgccattaccagaatctgaactggtcaacaaagcgacggcattgactgaagcagttaatcgccagctgcaccctaaaccggaagatgaatctcgcgtcagtgcctcattacgttcagcaattcaaaaatccggcatggtattgcttgatgattttggcgacattgtactgaagacagcggatttatgttctgccaaagatgactgtgtgcgactgaaaaatgcgctggtcaatctcggcaacagtaaagactgggacgcgctggtaaaacgcgccaacgccgggaagctcgatggcgtgaatgtgttattacgcccggtgagtgcggaatcgctggataacctggtggcaacctccaccgcgccgtttatcacgcatgaaacggcgcgagcggcacaatcactaaacagtccggcccccggcggattcctgattgtcagcgacgaaggcagcgattttgttgatcagccctggccttcggcatcactttacgactacccgccgcaagaacagtggaacgctttccagaaactggcacaaatgctgatgcatacgccgtttaacgccgagggtatcgtcacaaaaatcttcactgacgccaatggtacgcagcatattggccttcatccgatcccggatcgttccggcctgtggcgctatctcagcaccacattgctgctactgacgatgctgggtagcgccatttacaatggcgtacaggcctggcgtcgttaccagcgtcatcgcactcgcatgatggagattcaggcctattatgaaagctgcctgaacccgcaactgatcaccccttcagaaagccttatcgaataacacgtttgcgcggcaggttatgctaccctgtcgcgcaaattgcttcactctggagatttccctcatgcatatcaacattgcctggcaggacgtagataccgttctgctggatatggacggcacgttgctcgacctcgccttcgataactatttctggcaaaagctggtgcctgaaacatggggcgcgaaaaacggggttacgccacaggaagcgatggaatatatgcgccagcaatatcacgacgtacagcatacgctaaactggtactgtcttgattactggagtgagcaactgggtctggatatctgtgcgatgaccaccgagatgggaccgcgtgccgtactgcgtgaagataccattccgtttcttgaggcactgaaagccagcggtaagcagcgaattttgctcaccaatgcgcatccgcacaacctggcggtaaaacttgagcataccggtctggacgcacaccttgatttattactttccacccacacatttggttatccgaaagaggatcagcggttatggcatgcggtggccgaagctacgggtctgaaagctgaaagaacgctgtttattgatgacagcgaagcgattctcgatgctgccgcgcaatttggtattcgttactgcctcggcgtgactaatcctgattccgggattgccgagaaacagtatcaacgccatccgtcactgaatgactaccgccgcctgatcccctcgctaatgtgaaggagacgccatgaaagagaaacctgctgttgaggttcgactggataaatggctatgggctgcccgtttttataaaacccgcgcgctggcccgtgaaatgattgaaggcggtaaggtgcattacaacgggcagcgcagcaagccgagcaaaatcgtcgagctgaatgccacgctcactctgcgccagggaaatgacgaacgcacggtgattgtaaaggcgattactgaacagcgtcgccccgccagcgaggcagccttgctgtatgaagagactgcggaaagtgtagagaaacgcgaaaaaatggcgctggcacgtaaacttaatgccttaaccatgccgcacccggaccgacgcccggacaaaaaagagcgccgcgacctgttacgatttaaacacggcgacagtgaataactgtcacctgcaagagagatgattatgccgcaacatgaccaattacatcgctatctgtttgaaaactttgccgtgcgcggcgaactggtaaccgtttcggaaaccctgcaacagatccttgagaaccacgattatccgcagcccgttaaaaacgtgctggcagaactgctggttgcgaccagcctgttaaccgctacgctgaagtttgatggtgatatcaccgtacagctgcagggcgacggtccgatgaatctggcggttattaacggtaacaataaccagcagatgcgcggtgtggcgcgcgtgcagggcgaaattccagaaaatgccgacctgaaaacgctggtcggcaatggttacgtggtgatcaccattaccccgagcgaaggcgaacgctatcagggcgtagttggtctggaaggtgataccctggcggcctgcctggaagattactttatgcgttctgaacagctgccgacgcgcctgtttattcgcaccggcgacgtagacggcaaaccggctgcaggcggtatgttgttgcaggtaatgcctgcgcaaaatgcccagcaggacgactttgaccacctggcgacgctaaccgaaaccatcaaaaccgaagaactgctgaccttaccggcaaacgaagtgttgtggcgtttgtatcacgaagaagaggtgacggtttacgatccgcaggatgtggagttcaaatgcacctgctcgcgtgaacgttgcgccgatgcgctgaaaacgctgcctgatgaagaagttgatagcatcctggcggaagatggcgaaattgacatgcattgtgattactgcggtaaccactatctgttcaatgcgatggatattgctgaaatccgcaacaacgcgtctccggcagatccgcaagttcattaatgagtatgtccggcagagagggctctgccggattttacgactaatacacctgatgcgctttgtcactcattcagattcacattcagcctttcaccatccactacaagatcgcgccacgctttaggcttcgtccccagttttccatccttcgcagctgtgagtaatttttctttcgttatttcgttcggaagtaaactcatatcaagcgcgtcccattcttttctgtctgagtcaaagccatagacaatgactctgtcatcattaaaagcaaacaggatccgctccgcctgaccatcactattcagatcttgctcgaccaggacgcaggcgtctttttcaatacaggtcatcacgttatagcgatcctggattaaggccgaccagaatgtcgcatcaggtttaacagaaccaggggcaattaacacattatcggctaatactttttccgatacctgttgctgaagatgttgctctccatctaacgccatcagcagatcccgcgcgcgtttcgggtctttcataaacccggcatcgcttttcagcgactcaagcgcagcacgtccatagcgaccgctctgctcgagcatgtagatagttacctggtctgacgtgtttttgccgctctgataacgcgccatatggctgttcacgctaatgcgcatactgtccagcaccggcgaattaagaagcaccagtatcaccaacaccaataacgaaaccgcaaggttcactttgccctgaagaacaacgggattttgccctttacgccagacgatgctgacaaaataccccagcgaccacaccagtaacaccagcaccgccagcacgccctgcaagcggtcgacagtccagccgtactgagcgacccgcagccataacgcccaggcggcgacgaacacatacagcggagcaaccagcaaagcggttttaatcaggcaacgcaacggccctgtccagggaagtgacgctttttgcggatcgcggacaatagccattaagatcaattgcaaaaaggccagcgtcaacagcaacccggcggcggagatgtggcgagaaatcgcgctcaggcccgtaaacggcagggtgatgataaacatcagggttagcaatgatactaacggcagcaaccccgtggcgattaacgtgaacaacttttgaatagagtcgattaaacgtgactgtgttcgcgcgaggatcaccgccagcgcggtaaccagacctaacgtgagataaataaaccagtcggttgcaaaaaagagcgtattgaaaaacgtgatgccaacaagtttaaacaactcactccacagtaaaagcaccagccacgtcaagccattggcgagaaaaatcaccagtaatataagtacgttatgccatactgactggtaaaaatagcgatagcggctactgtcattgcggatgcgaaggctttgttgtatccacggtagcaacaacattgccatcaacagcagatagcaaccaaaatcccaaagcgccttttcagctctccaggggttcatgccatcagtttgccacttcagccagccgctcatccccagcgtggcaataaacactagcgccagccatccccaaaggcgcttctgtttaaaagagatcacggagaagagtaaaacggatgaaaacgcgacggtcgcaggcacgccataaacaatccaactgtgattttttccggaaagccaggcgatcagcaggtagcaaaccagaccctgaagtaatccggtagcaatcatcccccagcgtgttgcgggtgaaagttcaacgttatccatgttggttatccagaatcaaaaggtgggttaattatcgcatccgggcagtagtattttgcttttttcagaaaataatcaaaaaaagttagcgtggtgaatcgatactttaccggttgaatttgcatcaatttcattcaggaatgcgattccactcacaatattcccgccatataaaccaagatttaaccttttgagaacattttccacacctaaaatgctatttctgcgataatagcaaccgtttcgtgacaggaatcacggagttttttgtcaaatatgaatttctccagatacgtaaatctatgagccttgtcgcggttaacacccccaaaaagactttactattcaggcaatacatattggctaaggagcagtgaaatgcgcgttaacaatggtttgaccccgcaagaactcgaggcttatggtatcagtgacgtacatgatatcgtttacaacccaagctacgacctgctgtatcaggaagagctcgatccgagcctgacaggttatgagcgcggggtgttaactaatctgggtgccgttgccgtcgataccgggatcttcaccggtcgttcaccaaaagataagtatatcgtccgtgacgataccactcgcgatactttctggtgggcagacaaaggcaaaggtaagaacgacaacaaacctctctctccggaaacctggcagcatctgaaaggcctggtgaccaggcagctttccggcaaacgtctgttcgttgtcgacgctttctgtggtgcgaacccggatactcgtctttccgtccgtttcatcaccgaagtggcctggcaggcgcattttgtcaaaaacatgtttattcgcccgagcgatgaagaactggcaggtttcaaaccagactttatcgttatgaacggcgcgaagtgcactaacccgcagtggaaagaacagggtctcaactccgaaaacttcgtggcgtttaacctgaccgagcgcatgcagctgattggcggcacctggtacggcggcgaaatgaagaaagggatgttctcgatgatgaactacctgctgccgctgaaaggtatcgcttctatgcactgctccgccaacgttggtgagaaaggcgatgttgcggtgttcttcggcctttccggcaccggtaaaaccaccctttccaccgacccgaaacgtcgcctgattggcgatgacgaacacggctgggacgatgacggcgtgtttaacttcgaaggcggctgctacgcaaaaactatcaagctgtcgaaagaagcggaacctgaaatctacaacgctatccgtcgtgatgcgttgctggaaaacgtcaccgtgcgtgaagatggcactatcgactttgatgatggttcaaaaaccgagaacacccgcgtttcttatccgatctatcacatcgataacattgttaagccggtttccaaagcgggccacgcgactaaggttatcttcctgactgctgatgctttcggcgtgttgccgccggtttctcgcctgactgccgatcaaacccagtatcacttcctctctggcttcaccgccaaactggccggtactgagcgtggcatcaccgaaccgacgccaaccttctccgcttgcttcggcgcggcattcctgtcgctgcacccgactcagtacgcagaagtgctggtgaaacgtatgcaggcggcgggcgcgcaggcttatctggttaacactggctggaacggcactggcaaacgtatctcgattaaagatacccgcgccattatcgacgccatcctcaacggttcgctggataatgcagaaaccttcactctgccgatgtttaacctggcgatcccaaccgaactgccgggcgtagacacgaagattctcgatccgcgtaacacctacgcttctccggaacagtggcaggaaaaagccgaaaccctggcgaaactgtttatcgacaacttcgataaatacaccgacacccctgcgggtgccgcgctggtagcggctggtccgaaactgtaatgatttgaagctggagaatatctatccagtatcttatagaaagcaaaacgggaggcaccttcgcctcccgtttatttacccttcttttgtcgtgccctgcgcccgcgttaccggcactggcagccaggcgcgaatggaaagcccgccccgctcgctggtgccaagctccagcatcccgttatggttatccacgatacgctgcacaattgccagccctaatcccgtgccgctaatggtgcgcgcactgtcgccgcggacaaacggctggaacaggtgcttacgttgttccggcgcaattcccggaccgtcatcttccacctggaaccaggcgcgattcggctccgttccgctgctgactttgatccagccattgccataacgggcggcgttgaccaccatattcgccaccgcgcgtttgatcgacagcgggtgcattttcacttcaatgctgccggggtaaagcgcggtttcaatttcccgctcatagccactttcggcagcaatcacctcaccgagtactgcattaagatccgccatttccatcggcatctcctgcccggtgcgcaggtagtcgataaactgctcaatgatggcgttgcactcttcgatatctttattgatcgattctgccagatagccatcctgctcgctcatcatctcagtcgccaggcgaatacgcgtcagcggcgtgcgcaagtcgtgacttacccccgccatcagcagcgtgcggtcatccgccagttgcttaacaccagccgccatatggttaaaggcacgggtaacggaacgcacctccgaagcgccatactcacgcagcggcggcggaataatccctttaccaacctgcaaggctgcgtgttcgagatcgaccaacggtcggttctggatacgaataaacagccacgccccgcctatcgccaatagcataatcgccagcgtatagcggaacagcggagagaaatcgccctgatgaatttcggtcagcggcacgcgtacccagatattgggcgacagccaggttttcagccagacgacaggcgaacttttgttgacctcaacgcgcacttccgtcgggccgcccagttgctgcgccatctgatggcttaagaattcatagtgttgcgcccaacgcagacctgcctcttcggcagcctcgttggagtagagagagatccccagctcacggtagatctcccgacggaaagcgggaggcacaaccaactgcgtgccgtcctccagttgcagtttgtcggtcatcaacatacgcacttcgtacgcgaggactttattaaactgctggaggctcggcaaaatcgcgaagttcagcaccaccagataagtcgtcaccaggctggcgaacagcaaggtgacgatgagcaataacgtacgggcaaatgaacttcgtggcgagaagcgcaatcgcctcatgctttagagccgtccggtacaaagacgtagcccagaccccagacggtctgaatgtaacgcggatgcgctggatcttcttccaccatgcggcgcagacgcgaaatctgcacgtcgatggagcgttccattgcggaatattcacgaccacgggcaaggttcatcagcttatcgcgggagagcggctcacgcggatggctgaccagtgccttcagtaccgcaaactcaccgctggtgagcggcatcggctcgtcttcgcggaacatttcgcgcgtaccgaggttaagtttgaacttaccgaaagcaattaccgcctcttcctgtgacggtgcgcctggcagttcgttcgcctgacgacgcagcaccgcacggatacgggccagcagttcacgcgggttaaacggttttggaatgtagtcgtcagcgccaatctccaggcctacgatacggtccacttcttcccctttcgccgtcaccataatgatcggcatcgggttgctctgactacgaagacgtcggcaaatcgacaagccatcttcaccaggtaacattaaatccagtaccataagatggaaagattcacgagtcagcaggcgatccatctgttctgcattagcgacgcttcgaacctggaagccttgttcggtgagataacgttccagcagcgcacgcaggcgcatgtcgtcatcgaccaccagaatcttgtagttctcttgcattgtttgtactcccaaaggttcgcaacaatttgtaagcgtgtattcttaaaaaagctcacgttcgtcaccagctaaatctggtatgaatttcagcctaaattgttacaaagcatattaaacagcagcttaagtatacaatttattcggcgaaacattattgattctgttgatatgatcacgttatacccaatgtgcgcattatcaaacagacaaagggaatcaacgagatgaaaacgcccctggttacccgggaagggtatgaaaaactcaaacaagagcttaattatctctggcgtgaagaacgcccggaggtcacaaaaaaggtgacctgggccgcaagtctgggcgaccgcagcgaaaatgctgactatcagtataataaaaagcgtctgcgtgaaatcgaccgtcgcgtgcgctatctcactaaatgcctggaaaatctcaaaatcgtcgattactcccctcagcaggaaggcaaagtcttttttggcgcgtgggtggagattgaaaacgacgatggcgtgactcaccgtttccgtattgtcggctacgatgaaatttttggccgtaaagattacatctctatcgattccccgatggcccgcgcattgctgaaaaaagaagtcggcgatctggcggtggtgaatacccctgccggggaagcgagctggtatgttaatgctatcgagtacgtgaaaccgtaaggaagagtcttaacctcctgccgatggctggcatttttgccagccagtccgtataactatcccctgatttttgatccgaaaagatgaactcaaaccatgatgaatgattcgttctgccgcattattgcgggtgaaattcaggcgcgcccggaacaggttgacgctgccgttcgcctgcttgacgaagggaataccgtgccgtttatcgcacgttatcgtaaggaaatcaccggcggtctggatgacacgcagctgcgtaatctggaaacgcgtctgagctatctgcgcgagctggaagagagacgtcaggcgatcctcaagtccatttccgagcaaggcaaactcaccgatgatctggcgaaggccatcaacgccaccctaagcaaaaccgaactcgaagacctctacctgccctacaaacctaaacgccgcacccgcgggcaaatcgccattgaagcagggcttgagccgttggctgacctgctgtggagcgatccgtcacacacgccagaagtcgccgctgcacaatatgtttatgccgataaaggcgtggcagataccaaagccgcgctggatggcgcgcgctatatcctgatggaacggtttgccgaagatgccgcgctgctggcgaaagtgcgtgattatctgtggaagaacgcgcatttggtttctacggtggtgagcggtaaagaagaggaaggggcgaaattccgcgactatttcgatcatcacgaaccgttgtccacggtgccttctcaccgcgcgctggcgatgttccgtgggcgtaacgaaggcgtacttcagctttcgctgaatgccgatccacagttcgatgagccgcccaaagagagctattgcgagcaaatcatcatggatcaccttggcctgcgcctgaacaatgccccggcggatagctggcgcaaaggcgtggtgagctggacgtggcgcatcaaggtgctgatgcatctggaaaccgaactgatgggcaccgtgcgcgaacgtgcggaagatgaagcaatcaacgtctttgcccgtaacctgcacgatctgctgatggcggcccctgccggactgcgtgcaacgatgggcctcgatccgggtctgcgtactggggtaaaagtggcggtggtcgatgccactggcaaactggtggcgaccgacaccatttacccgcacaccggacaggccgcaaaagcagcgatgaccgttgctgcgctgtgtgaaaaacataacgttgaactggtagcgatcggtaacggtacagcttcccgcgaaactgagcgtttctatctcgatgtgcagaagcagttcccgaaagtgaccgcgcagaaagtaatcgtcagcgaagcaggcgcgtcggtttactcggcttccgagctggctgcacaggagttcccggatctcgacgtttcgctgcgtggcgcggtgtctatcgcccgccgtttgcaggatccgctggcggagctggtgaaaatcgatccgaaatctatcggcgtaggtcagtatcagcatgacgtcagccagacgcaactggcccgcaaactggacgcagtagtagaagactgcgtaaacgccgttggcgtcgatctcaacactgcttctgttccgctgttaacccgcgtggcgggcctgacgcgcatgatggcgcaaaacatcgttgcctggcgcgatgagaacggtcagttccagaaccgtcagcaactgttaaaagtgagccgtctggggccgaaagccttcgagcagtgcgcgggcttcttgcgcattaaccacggtgataacccgctggacgcgtctaccgttcacccggaagcctatccggtggtggaacgcattctggcagcaacacagcaggcactgaaagatctgatgggtaacagcagcgaactgcgtaacctgaaagcgtctgactttactgatgagaaattcggtgtgccgacggtaaccgacatcatcaaagagctggaaaaaccgggtcgcgatccgcgtccggaatttaaaaccgctcagtttgccgatggcgtcgagacaatgaacgacctgcaaccgggtatgatcctcgaaggcgcagtgaccaacgtcaccaactttggcgcgtttgtcgatattggcgtgcatcaggacggcctggttcacatctcttcattgtcgaacaagtttgtggaagatccgcataccgtggtgaaagcgggcgacattgtgaaggtgaaagtgctggaagtggatcttcagcgtaaacgtatcgccctgactatgcgcctggatgagcagcctggcgaaaccaacgctcgtcgcggcggcggtaatgaacgcccgcaaaacaaccgcccggcagccaaaccacgcggtcgtgaagcgcagcctgccggtaatagcgcgatgatggatgcgctggcggcggcaatgggcaaaaaacgttaaacgcccgtactggcctacggttcgaatttgcacgaaatcgtagggcagataaggcgttcacgccgcatctggcaacgaacgccttgcctgacataaaagtgccggagaatatctccggcatttttattccacagccaaactcataatatattccggcaatatttatcatttcattaacaactgaaaccttaattaaacattagccagtccgggtaattcactattcgaattatattttcgctgcgatataaccttgagccacatcaacattgagtcagattattattcaaaccaacattcgcacacattttaagtattgctgatagaaaccattctcattatcattgtgttgttgattatttaatctctcctttgttggcaaatcatctggtctcatgtcgctgtcaaacgccccatgaggtagttatccagttaatgagaaacaagtaggcacctatgcaatacactccagatactgcgtggaaaatcactggcttttcccgtgaaatcagcccggcatatcgccaaaaactgctttctcttggcatgttacctggctcctcttttaatgtggtgcgcgtcgctccactcggcgaccccattcatatcgaaacccgtcgtgtgagcctggtattacgcaaaaaagatctggccttattagaagtggaagcggtttcctgttaatacggtgataacaacaatgaaaaaattaaccattggcttaattggtaatccaaattctggcaagacaacgttatttaaccagctcactggctcacgtcagcgtgtaggtaactgggctggcgttaccgtcgaacgtaaagaagggcaattctccaccaccgatcatcaggtcacgctggtggacctgcccggcacctattctctgaccaccatctcatcgcagacctcgctcgatgagcaaatcgcctgtcactacattttgagtggcgacgccgacctgctgattaacgtggtggatgcgtctaaccttgagcgtaacctgtacctgacgctacaactgctggaactcggcattccctgcattgtggcactgaacatgctcgacattgccgagaagcaaaatattcgtattgaaattgatgctctgtcggcgcgtctgggctgtccggtgatcccgctggtttcaacccgtggtcgcggtattgaagcgctcaagctggcgattgatcgctataaagctaacgagaatgtggaactggtgcattacgcacagccgctgctcaacgaagcagattcactggcaaaagtgatgccttccgacatcccgctgaaacaacgtcgctggctgggcctgcaaatgctggaaggcgatatctacagccgcgcctacgccggtgaagcgtcgcagcatctggatgccgccctcgcccgtctgcgtaatgagatggacgatccggcgctgcacattgccgatgcgcgttaccagtgcattgctgccatctgtgatgtggtaagcaacaccctgacggcagaacccagccgtttcaccactgcggtagataaaatcgtgctcaaccgtttcctcggtctgccgattttcctctttgtgatgtacctgatgttcctgctggctatcaacatcggcggggcgttacagccgctgtttgacgtcggctccgtggcgctatttgtgcatggtattcaatggattggctacacgctccacttcccggactggctgactatcttcctcgcccagggcctgggtggcggcattaacaccgtgctgccactggtgccgcagattggcatgatgtacctgttcctctccttccttgaggactccgggtatatggcgcgtgcggcgtttgtgatggaccgtctgatgcaggcgctgggcttgccggggaaatcctttgtgccgctgatcgtcggtttcggttgtaacgtaccgtcggtaatgggtgcacgtacgcttgatgcaccgcgtgaacgtctgatgaccatcatgatggcaccgtttatgtcctgcggcgcgcgtctggctatcttcgcagtattcgcggctgccttcttcgggcagaacggtgcgctggcggtcttctcgctgtatatgctgggtattgtgatggcggtgctgactggcctgatgctcaagtacaccatcatgcgcggtgaagcgacgccgtttgtcatggagttgccggtctatcatgtaccacacgttaaaagcctgattatccagacctggcagcgtctgaaaggcttcgttctgcgtgctggtaaagtgatcatcatcgtcagcattttcctgagcgctttcaacagcttctcgctgagcgggaaaatcgtcgataacatcaacgactcggcgctggcgtccgtcagccgggtgatcaccccggtcttcaagccaattggcgtgcatgaagataactggcaggcaacggttggcctgtttacaggtgccatggcgaaagaagtggtagtgggtacgctcaacaccctctacaccgcagaaaatattcaggacgaagagttcaatccggcagaatttaacctcggtgaagagctgttcagtgcgatagatgaaacctggcagagcctgaaagacaccttcagccttagcgtactgatgaaccccattgaagccagcaaaggcgacggcgaaatgggtaccggggcgatgggcgtgatggatcagaaattcggtagcgcagcagcagcttacagctacctgattttcgtcctgctgtatgtaccatgtatctcggtgatgggggctatcgcccgtgaatcaagccgtggctggatgggcttctccatcctgtgggggctgaatatcgcttactcactggcaacattgttctatcaggtcgccagctacagtcagcatccaacttacagcctggtgtgcattctggcggttatcctgtttaacatcgtggttatcggtctgctgcgccgcgcgcgtagccgggtggatatcgaactgctggcaacccgcaagtcggtaagcagttgctgcgcagccagcaccaccggtgattgccattaatggcttcacttattcaggtgcgcgatttgctggcgttacggggccgtatggaagcggcccagataagccagacattgaacactccacagccaatgattaacgccatgctgcaacaactggaaagtatgggcaaagccgtgcggattcaggaagaacctgacggctgcctctctggcagttgtaaaagctgcccggaaggaaaagcctgtctgcgcgagtggtgggcgctgcgttaaccttactccatcgcctgttttggaaagcccggtatgcgtctgcatccgggcttttttgcgtgcggctttccataaaaatgcaactcttgcagcacggcgtaagttcctttgaaagcatctcgcagggatgaaaactcgctaatacacaggtgtggagtggcgcgtagagtcgcggcattcaaacaacaggtgaaggaacgccatgagcaaaaagcagagttccaccccacacgatgcgctgttcaaactctttttacgccaaccggacacggctcgtgattttcttgcgtttcatttaccggcacccattcacgcgctttgtgatatgaaaaccctcaagctggagtcgagcagctttattgatgacgatctgcgtgaaagctattccgatgtgctgtggtcggtgaaaacggaacaaggaccaggatacatctattgtctgattgaacatcaaagcacctcaaacaaactgatcgcatttcgcatgatgcgttacgctattgccgcaatgcaaaatcaccttgatgctggatacaaaacgttgccgatggtggtgccattgttgttttaccacggtattgaaagcccctatccctattcgctgtgttggctggattgtttcgccgatcccaaactggcaaggcagctttatgcctccgcatttccgctgattgatgtcaccgtcatgcctgatgatgaaatcatgcagcaccgacgtatggcgctgctggagttaattcaaaaacatattcgtcaacgcgacctgatggggctggtagagcaaatggcctgcttattaagtagtggatacgctaatgacagacaaatcaaagggctgtttaattacatactgcaaactggcgacgctgtacgttttaacgattttatcgacggcgttgccgaacgttcaccgaaacacaaggagagtttaatgactattgcggaaagattgcggcaggagggggaacaatccaaagccctgcatatagccaaaataatgcttgaatccggagttcctcttgcagacatcatgcgctttaccgggctgtcagaagaagagttggctgcggcgagtcagtaaagttctgtctcgccatttcaaaagccacctacaccctctgcttcaacgccaccagcaggtgacaaaactcggccggatgcgaaataaatggcgcatgggccgctttggcgaagatatatgattcgctgtgaggccaaagtttatccagcatcggcaccactttgcgcggcaccagaccgtcgagatagccatacaatcgcaaaaacggcatggacacgttttgcagcggctgacggagatcgaccgttttcaggatttccagcccgccattaagcacgtcaacctccggcatcggtaacgccagaacggttttcttcaacgcccgcgcatcctggcgcgccgtttcagtccccatggtttgtaacgccaggaaccgctccactgtacgctgaaaatcatcactgagttgctgctgaaatcccgccagcacgtccggttttatccccggccactcgtcacgagcactaaaacaaggtgacgacgccacggtgaccagcgcctgaacacgctcgggatgggttaacgcaatctggcttgccaccagcccgcccagactccagcctaaccaaatggctttatcaggtgcctgttgcagcacggcttcggccatatcagcaagtgacagcgcaccaaatccccggctacgcccgaagccgggcaggtcaacaaggtgcagcgtaaaatgcgagctaagttcctcgtcaatgcaacgccacacttcggcattcagtccccatccgtgcagcagcacaagatgaacattcccctgacctttggtctgccaccagatgttattcatccgctattgttctcttttgacttacaaggatgaacatatgctaacagtaccgggattatgctggctatgccgaatgccactggcgttaggtcattgggggatttgttcggtctgttcacgcgccacccgcacagataaaacgttatgcccacaatgtggattacccgccacacactcccatcttccctgcggtcgctgcctgcaaaaaccgccgccctggcaaagactggtcacggttgccgactatgcgccgccgttaagtccgcttatccaccagcttaaattttcccggcgcagtgaaatcgccagcgccctgtcacgtctgttactattggaagtcttacacgctcgtcgcaccaccgggttgcaattgccggatcgcatcgtcagcgttccgttatggcagcggcgtcactggcgtcggggatttaatcagagcgatttgctgtgtcagccgttatcacgctggttgcactgccaatgggatagcgaagccgtcacacgtacacgggccactgcgacccagcattttctcagtgcccggctgcgcaagcgcaacctgaaaaatgcctttcgtcttgaattgcccgtgcaaggtcgccatatggtgattgtggatgatgtcgttaccaccggaagtaccgtcgcagagattgcgcagttgcttttacgcaatggtgcggcggctgtccaggtctggtgcctttgtcgaaccttgtagagcctcgatgatgggcgtattataaccaactaaaatagtcaactattaggccattactatgatccgtatttccgatgctgcacaagcgcactttgccaaactgctggcaaatcaggaagaagggacacaaatccgcgtatttgtgattaaccctggcacgcctaacgctgaatgtggcgtttcttattgtccgccggacgctgtggaagccaccgacacagccctgaaatttgacctgctgaccgcgtatgttgatgagttaagcgcaccatacctggaagatgcagagatcgattttgttaccgaccagttgggttcccagttaacgctgaaagccccgaacgccaaaatgcgtaaagtggcagacgatgcaccgctgatggagcgcgtggagtatatgctgcagtcgcagatcaacccacagcttgctggtcacggtggtcgcgtttcgctgatggaaatcaccgaagacggttacgccattctgcaatttggcggcggctgtaacggttgttccatggtcgatgtgacgctgaaagaagggatcgagaagcagctgctgaacgaattcccggagctgaaaggtgtgcgcgatctcaccgaacaccagcgcggcgaacactcctactactaagttatcccctcttttgtagattgcccgatgcgacgctaaagcgtcatttcgggcctacgttgaacatgtgccagacgttggcgcagcattgctttgtcaaatcctcggttcgtttccccgcgataatatgaccaacctctcataatttaaatttaccccgctctggtgattctcaaacgccagatgttacccgtatcattcacatgggtaccaaacatactcctgacatctgactacaataattagttttagtgggtatcagtcgtggtgccgcaatatctctgttcccgattgggataattagagtttgtcgtcagaaaattgacgttacccataacaaatgaaaggccaggtaaatcatgccattagtcattgttgctatcggtgtaatcttgttgttgctcctgatgatccgcttcaaaatgaacggcttcatcgctctcgtcctcgtggcgcttgctgttggattaatgcaaggaatgccgctggataaagttattggctccatcaaagccggtgtcggcgggacgctcggtagccttgccctgatcatgggttttggcgcaatgctgggcaaaatgctggcagactgcggtggcgcacaacgtatcgccaccacgctgattgccaaatttggtaaaaaacacatccagtgggcggtggtactgaccggttttaccgttggttttgccctgttctatgaagtgggctttgtgctgatgctgccgctggtgtttaccatcgcggcttctgcgaatattccactgctgtatgttggtgtaccaatggcggctgcactgtctgtgacccacggcttcctgccaccgcatccgggtccgactgcgattgccaccattttcaatgccgatatgggtaaaaccctgctgtacggtactattctggcaatcccgaccgtgattctcgccggtccggtttacgctcgcgtgttgaaaggtatcgataagccaattccggaaggtctctacagcgcgaaaaccttcagcgaagaagagatgccgagctttggcgtcagcgtctggacctctctggtgccggtagtactgatggcgatgcgtgcgattgccgaaatgatcctgccgaaaggtcacgctttcctgccggtagcggagttcctcggtgacccggtaatggcaacgctgattgccgtgctgattgcgatgttcacctttggtctaaaccgtggtcgttcaatggatcagattaacgacacgctggtttcttccatcaaaatcattgcgatgatgctgttgatcatcggtggtggcggtgcgttcaagcaggtgctggtagacagcggcgtggacaaatacattgcttccatgatgcacgaaaccaacatttctccgctgctgatggcctggtcgattgctgccgtactgcgtatcgcgctgggttccgcaaccgttgcggcaatcactgcgggtggtatcgcggcaccgctgattgcaacgacgggtgttagcccggagctgatggttattgcggttggttccggtagtgtgattttctctcatgtgaacgatccgggcttctggctgttcaaagagtactttaacctgactatcggcgagaccatcaaatcctggtcgatgctggaaaccattatctcggtgtgcggtctggtaggctgtctgctgctgaatatggtgatttgataacactgactgccggatgcggcgtgaccgccttatccggcctacgattcgggatgaattagtaggccggataagacgcgtcaagcatcgcatccggcatcaaccgcactctacttcttcttcgctgcagctctgcgccgtctgtccaaatccttcagcaacttgttcacgccatcatcggcaaacatcgactcaagcgttgcggaaagcttgcgtcgccagtttttatactggtaactggtgccaggaatattcaccggttcggccatatccagccagtcttccggctgtagtcctaacagagcactgttactgtcggcaatgtagcgctgcaaaccacggttcagcgtcggcgtcatcgacatcaacgatgccttatgcccggcacgtttcggcagacaaccatatttatgcagtgcatccagcagcccttgcttcgccagttcgcgatcctgatacagaccgcgcagtaccacttcatccggatacagccccagggttttgcccagcgttagatccccgcactcccagtaaccgcgcagcgttggcaggtcatgtgtcgccgcaaccgccatcgactgctccggatacgctttcggtgcacggaacgtcttctcgtggtcgttttcgaaatagagcactttgtaagagtacacaccgctgctgcgcagcttaccgacaatctctaccggtacggtaccgagatcttcaccaatcaccatacagcgatgacgtttactttcgagtgccagaatcgagagcagatcatccaccggatagtgaacatacgcgccctgatctgccgtctcgccatacggtatccaccacaaacgcagcatcgacatcacatggtcaattcgtaatgcgccgcagttttgcatattggcacgcaacagctcgataaacggttcataggcacgcgcggtgatgatatgcgggtccattggcggtaatccccagttctgccccaacgggccgaggatatccggcggcgcgccaaccgatgctttcaggcaatatagttcacggtcacaccaggtttccgccccaccttccgctacgccaaccgccagatcacgatacaagccaatcggcatttcatagccctggcttatctcccagcaggcggcaaactggctgtaagccagccactgcaaccagagataaaaatcgacgtcatcacgatgttcttcgcagaactgacgcacttctggtgaatccacgttctgatacatctctggccatgcaggccagccccagcgcatttcgtcctctttcacttgctgggcatgtagcgcatcaaaggctgcctgccagaacaggctgtcgccctgctctgcaacaaactggcgaaacgcggccatctgctcatcatcacgttgcgcgaaacctttccacgccattcgtaatgctgtcatttttagggcggtaaccgtggagtaatcgacccagtcggcatcgcgcgcctgttgcagcgtctgttgcgtggtcggcaactgccaccaggcctgagcctcttcgctaagatggaaatcttcaacggcgttaacgtcgatataaatcacattcagccaacggcgagaagacgggctgtatgggctggcgctctccggatttgccggatagagcgcatgaatcgggttcaggccaatgaacgacccgccacgttttgccacatccaccagcatcgctttgagatcgccaaaatccccaataccccagtttttttccgatcgcagcgtataaagctgaacgcaggcaccccacagcttttgtttattcagcaacgcctgcggttcgtaacagcgtttcggggcgacaatcacccggcaatgcgcgcgctggtcgtcctgggtgagtgtcagcgtgtgataaccttccggcagcttcgtcggtagattgaacgctttgccccccgttacatggcctttgtactgcgttccttcttcggtggtcagcagccagctatattcgccgctgccctccaccaccatcggcatttttttgccgctggtataaaccatgacattcgggactggcgttaccgccactttcgtggcggtacgttgatgcatcgcgtcaagcaaacgccgtttggtttcggcgctaatcgactgcggtttaccgtgggcattgatgtaattggggctaatccccgccgccagcgcggcattatccagacgtttgctttccatcgagcttccttagcgttttgcctgccagatacgagcctgataatcgcgaatagagcgatccgagctaaacataccgcagcgggcggtattgaggatcgccgcgcgagtccaggcctcctggtcgcggtacagcacatccacctgcttttgtgcctctacataggctgcgaaatccgccatcaccagatacggatcgccgccctgtttgccgatactgtgcagcatctggtcgaaggcatgcttatcgccgtcgctgtatttaccgctttccagctctttcaatactgcgtccagcaccttatctttcttccgccatttcaccgggtcgtagcctttggccagaattgccttcacttgttccacggtatgaccaaaaataaagatattttcttcaccgactttctcggcgatttcaacgttcgccccatccagcgtaccgacagtaagcgcaccattgagcgccagtttcatattgccggtaccggaagcttctttacctgcagtcgaaatttgttcggagatatccgccgccgggatcagtttttccgccgccgaaacgcaataatccggcaggaacaccaccttcaacttatcgccaaccagcggatcgttgttgatcacgtcagccactttgttgatcgcaaagataatattcttcgccaggtagtagcccggtgccgctttcgcgccgaagaggaagacgcgcggtacgcgatcagcctgcgggttttcacgaatttctttgtacaacgccagaatatgcagcagattcaggtgctggcgtttgtactcatgcaaacgtttgatctgaatatcgaaaatcgcctgtggattgatctcaataccggtacgaactttcacaaactccgccagacggactttattcgcctgcttgatctcgcgatattgctgacggaatttcgcatcatcagcgaatttttccagattgatcagctgatcgagatcgttagcccactctttttgcagtgatttatccaacagagccgccagtgccgggttgcactgtttgatccagcgacgtggggtaataccgttggtgacgttatggaatttgttcggccatagctggtgatattccgggaacagatctttcaccaccagatccgagtgcagcgccgcaacaccgttcaccgcgaaaccgccaaccacacacaggttcgccatatgcacttgtttgtcgtgcaccaccgccagtttggcccacactttttcatcgcccggccaggttttctctaccagcgttttaaagcgagtattaatttcgttaataatctgcatgtggcgcggcagtaagcctttcaccagtttcacatcccagcgttccagcgcttctggcatcagggtatggttggtgtaagcgaaagttttgctggtaatggcccaggcgtcatcccagctcatctggtgctcatcgatcagcacgcgcagcagttctggaatcgcgatagttgggtgggtatcgttcagctgaataacttcgtaatccgccagttcgtgcagtttacgccccgccagatgatggcgacgcaaaatatccgctaccgaacaggcacactggaagtattgctgcatcaggcgcagctttttaccggcagtatggttgtcgtttggatagagaactttggtcagtttttccgcattgatgccctgctgttcggcacgcaagaaatcaccgtcgttaaatttagtcagatcaaacggatgcgcgtgcgtcgcctgccacagacgcagcggctgcgccacgccattacgatagccgacaacggggagatcccacgcttgaccggtaatggtaaactccggctcccagcgtccgtctttcgtcactttaccgccaatccctacctgcacatccagtgcttcgttgtggcggaaccacgggtagttactgcgatgccagtcatccggcgcttcaacctgtttgccatcgacaaaagactggcggaacaaaccatattgatagttcagaccgtaacccgtcgcagactgaccgacagttgccattgagtcgaggaagcacgccgccagacgtcccagaccaccgttacccagcgccgggtcgatctcttcttccagcaggtccgtcagattgatgtcataagccttcaacgaatcctgtacatcctgataccagccgagattcaacaggttgttgcccgtcaggcgaccaatcaaaaactccattgagatgtagttaacatgtcgctgattcgccaccggcttggcgaatggctgagcacgcagcatttcggccagtgcttcactcactgctagccaccactggcgaggagtcatttcagccgcagaatttaagccataacgctgccactgacgtgaaagcgcttcctgaaattgcttatcgttaaaaataggttgtgacataggagttccacttttcttagattttcaacacaacgttatcgctagtttgccaggctcgatgttgaccttcctcatcctgcgggggattaggcagggaggagttgcggggatgagcaaggaaatgtgatctcaaccacttaaagctagtgcaaaccacaggattagcatcaaatcaatgcaatacagcgcagaaaatctgtatctaagtgcaaaaaatggccgttgcgtattttcaaaaagcggaaggtaactctataaattaagtaaaggagtgaaacagtttcataagtaaaatatccagtgtgctccatctcattcttaatagatttattaagatcatctttttagatggcactttcatcaggaatgaagaagaaacccttgcttaaatgaatctgatgaacataagggaaaccagtattcacgctggatcagcgtcgttttaggtgagttgttaataaagatttggaattgtgacacagtgcaaattcagacacataaaaaaacgtcatcgcttgcattagaaaggtttctggccgaccttataaccattaattacgaagcgcaaaaaaaataatatttcctcattttccacagtgaagtgattaactatgctgattccgtcaaaactaagtcgtccggttcgactcgaccataccgtggttcgtgagcgcctgctggctaaactttccggcgcgaacaacttccggctggcgctgatcacgagtcctgcgggctacggaaagaccaccctcatttcccagtgggcggcaggcaaaaacgatatcggctggtactcgctggatgaaggtgataaccagcaagagcgtttcgccagctatctcattgccgccgtgcagcaggcaaccaacggtcactgtgcgatatgtgagacgatggcgcaaaaacggcaatatgccagcctgacgtcactcttcgcccagcttttcattgagctggcggaatggcatagcccactttatctggtcatcgatgactatcatctgatcactaatccagtgatccacgagtcaatgcgcttctttattcgccatcaaccagaaaatctcaccctggtggtgttgtcacgcaaccttccgcaactgggcattgccaatctgcgtgttcgtgatcaactgctggaaattggcagtcagcaactggcatttacccatcaggaagcgaagcagttttttgattgccgtctgtcatcgccgattgaagccgcagaaagcagtcggatttgcgatgacgtttccggttgggcgacggcactacagctaatcgccctctccgcccggcagaatacccactcagcccataagtcggcacgccgcctggcgggaatcaatgccagccatctttcggattatctggtcgatgaggttttggataacgtcgatctcgcaacgcgccattttctgttgaaaagcgccattttgcgctcaatgaacgatgccctcatcacccgtgtgaccggcgaagaaaacgggcaaatgcgcctcgaagagattgagcgtcaggggctgtttttacagcggatggatgataccggcgagtggttctgctatcacccgctgtttggtaacttcctgcgccagcgctgccagtgggaactggcggcggagctgccggaaatccaccgtgccgccgcagaaagctggatggcccagggatttcccagcgaagcaattcatcatgcgctggcggcaggcgatgcgctgatgctgcgcgatattctgcttaatcacgcctggagtctgttcaaccatagcgaactgtcgctgctggaagagtcgcttaaggccctgccgtgggacagcttgctggaaaatccgcagttggtgttattgcaggcgtggctgatgcaaagccaacatcgctacggcgaagttaacaccctgctagcccgtgctgaacatgaaatcaaggacatcagagaagacaccatgcacgcagaatttaacgctctgcgcgcccaggtggcgattaacgatggtaatccggatgaagcggaacggctggcaaaactggcactggaagagctgccgccgggctggttctatagccgcattgtggcaacctcggtgctgggtgaagtgctgcactgcaaaggcgaattgacccgctcactggcgctaatgcagcaaaccgaacagatggcacgccagcacgatgtctggcactacgctttgtggagtttaatccagcaaagtgaaattctgtttgcccaagggttcctgcaaaccgcgtgggaaacgcaggaaaaagcattccagctgatcaacgagcagcatctggaacagctgccaatgcatgagtttctggtgcgcattcgtgcgcagctgttatgggcctgggcgcggctggatgaagccgaagcgtcggcgcgtagcgggattgaagtcttgtcgtcttatcagccacagcaacagcttcagtgcctggcaatgttgattcaatgctcgctggcccgtggtgatttagataacgcccgtagccagctgaaccgtctggaaaacctgctggggaatggcaaatatcacagcgactggatctctaacgccaacaaagtccgggtgatttactggcaaatgaccggcgataaagccgccgctgccaactggttgcgtcatacggctaaaccagagtttgcgaacaaccacttcctgcaaggtcaatggcgcaacattgcccgtgcacaaatcttgctgggcgagtttgaaccggcagaaattgttctcgaagaactcaatgaaaatgcccggagtctgcggttgatgagcgatctcaaccgtaacctgttgctgcttaatcaactgtactggcaggccggacgtaaaagtgacgcccagcgcgtgttgctggacgcattaaaactggcgaatcgcaccggatttatcagccattttgtcatcgaaggcgaagcgatggcgcaacaactgcgtcagctgattcagcttaatacgctgccggaactggaacagcatcgcgcgcagcgtattctgcgagaaatcaatcaacatcatcggcataaattcgcccatttcgatgagaatttcgttgaacgtctgctaaatcatcctgaagtacctgaactgatccgcaccagcccgctgacgcaacgtgaatggcaggtactggggctgatctactctggttacagcaatgagcaaattgccggagaactggaagtcgcggcaaccaccatcaaaacgcatatccgcaatctgtatcagaaactcggcgtggcccatcgccaggatgcggtacaacacgcccagcaattgctgaagatgatggggtacggcgtgtaagtttagccggataacgcgccagatccggcttacatctctgcatcattcaatgctcacccgcgttacgccatctgtttctatcaaactaaaccgcaccggcaagaaacgctccaccaccgcgatattggtcagcagatggcatgagggatgggcgaccgtaaattcccccgcgcccgccagcgccatcggtagcaccagttggtcagcaagatattcccccaccgccgccgtgcttgccaggtagcgtttcacctctttcaccaactgtgccgcaaccacctcggcactgacgcgcttttcaccgacgacaaaaaagcgttcggtgatattttcactttcgacttcaagcgagacggtattacccggcccctggtcgcgcggcaggttatgaatattctgttcatgcagggaaaaactccccgccagtgtagcgatttcacgctcagcaacatggcgcggcacaccagctaatagaacttctccacgcatctgcacaatgttcccgcgctcgccaagttgcaaggtgttaaacgatgccacgggcgagacttccgttgccaccacaccgcctccggcagggtaaaaaccgtggcgtaacagcgtggtttgctgatgaattcctattttcgccagcagcggctccagcacccggcggataaaatccgcaggcggcgccgacgggttatcggtgccgccgctcacttcaacacgcgaaggtccatcggcaaaccacagcgcgggcagcaccgtttgcagcaccagcgtacaacttccggcgctaccgatagcaaagcggtaatcgccgccgcgcacggtgccgggccggaagagcagacgctgcgaccccagctccgcgccttccacggttgctccgcaaatttccgtcgccgcctttaccgcggtcagatgctggcgcaacagccccggtttcgcccgcccggcacgaatgctggtgatggtaaatggctggccggttatcatcgacaggctcagcgccgagcgcaggatctgcccgccaccttcgccctgtgcgccatccagcgcaatcatccttttcatcatttatccttttacgcacaccacctgacgcagggtatagataacttccaccagatcgctttgtgccgccatcaccgcatcaatatctttatacgccatcgggatttcgtcgatcacttcggcatctttacggcattccacatgcgcggtggcacgaatttgatcttccacgctgaacagttttttcgctttagttcggctcattacccgcccggcaccgtggctgcacgaacagaacgactcttcatttcccagcccacggacgataaagctttttgctcccatcgaaccgggaataattccatattgaccagcacgcgcagacaccgcgcctttacgcgtcacgtagatctcttcaccaaagtgctgttctttttgcacatagttgtggtgacagttgatctcttccatcgccagcgtttgtggctgtctgaccgttttctgcgtaatgctctgcaatgccgttaccacgttttccatcatcgcatcgcggttaaggctggcaaaaagctgcgcccaggccacggctttcaggtaatcatcaaagtattccgtaccttccataaagtacgccagatcacgcgacggcaacgtctcaagcgtttcctgcatctctttttgtgccagatcgataaagtaagtcccgatggcgttaccaattccgcgtgaaccggagtgcagcataatccacacctggtccgactcatcaaggcagatttcaataaagtggttaccggttcccagcgttcccaggtgtttatagttattggtattcaggaaacggggatatttttgcgttaaccactgataaccggcttcaagctcagcccatttagcatcgacgttaacaggtggattttcccaggcacctttatcacgtttacaacggccagtggtacgcccgtgcggcacggccgtttcaatcgcctgacgcagctctgccaggttttcaggcaggtcttccgccgttaacgcggtacgcagcgcgttcattccacagccaatatccacgcccaccgccgccggaataatcgcccctttggtcgggatcacgctaccaatggtggaacctttacccaggtgtacatcaggcattaccgcaatatgtttgaaaataaacggcatcttcgccgtattaataagttgctgacgcgcatcggcctctaccggcacgcctttggtccacatttttaccggggcattttcagtggtcagtaattcgtaattcattttgtttttctcttttcgttgtttgctgtcctgataattgcaaccgtcgtgccagaaaattaaataagcagcttaattttttaattcattgttttaaaaaagattatatctttacgtccgtaaccggagatttcccgcaaagccaatttaccgataatgaaatatcgtcttttataaggatatctaagatgcgtaaaacagtggcttttggctttgtcggtaccgtactggattatgccgggcgcggcagtcagcgctggtcaaaatggcgtccgacactctgtttatgccagcaagaatcgttggtcatcgatcgactggaattgttgcacgacgcccgctcgcgctcgctatttgaaacgcttaaacgcgatatcgccagcgtttcgccagaaacagaagtggtgagcgttgagattgaactgcataacccgtgggatttcgaagaggtctacgcctgcctgcatgatttcgcccgtggttacgagtttcagccagaaaaagaagactatttaattcacatcaccaccggtacccacgtcgcgcagatttgctggtttctgctggcagaagcgcgttacctgcccgcccggctgatacaatcttcacctccgcgcaaaaaagaacagccgcgcggcccaggtgaagtaacgattatcgatctcgatttaagccgttataacgccatcgccagccgctttgccgaggaacgccagcaaacgcttgattttcttaagtccggcattgccacgcgtaacccccacttcaaccgcatgattgagcagatcgaaaaagtggcgatcaaatcccgcgcgccgattctgcttaacggtccaaccggcgcgggcaagtcatttctggcgcgacgcatcttagagttaaaacaggcgcggcatcagtttagcggcgcgtttgtggaagtgaactgcgccaccctgcgcggcgataccgccatgtcgacgctgtttggtcatgtaaaaggcgcgtttaccggggcgcgggaatctcgtgaaggtttattacgcagcgccaacggcggaatgttgtttcttgatgagattggcgaactgggcgcagacgaacaggcaatgctgctgaaagccattgaagagaaaaccttttacccgtttggcagcgatcgccaggtgagcagtgattttcagcttatcgccggaacggtgcgcgatttgcgccagctggttgccgaaggcaaatttcgcgaagatctgtacgcgcggatcaatctctggaccttcaccctgccgggtctacgccagcgccaggaagatattgaaccgaacctggattatgaagtggagcgccacgcctcactcactggcgacagcgtgcgttttaacaccgaagcgcggcgcgcctggttggcttttgcgacctctccccaggcaacatggcgcggtaactttcgcgaactttctgccagcgtcacgcggatggccacctttgccactagcggacgcatcactctggacgtggttgaagatgagataaaccgtctgcgctataactggcaggagagccgcccctccgcgcttacggcgttgctgggcgcagaggcagaaaacatcgatctcttcgaccgtatgcaactggaacacgttatcgctatctgccgccaggcaaagtcgctttccgcagccggacgccagctttttgacgtttcgcgccagggcaaagccagcgtcaatgacgcggatcggctacgcaaatacctggcgcgttttggtctgacgtgggaagccgtgcaggatcagcacagctccagttgaatatggtggtccgtcagcacctgcatcacgcttactggcggcggggcgtcggtgtagacggcatctaccatgctgatgctgcccatattgaccatcgcgttacggccaaatttcgagtgatcgacaaccagcataacgtggcgcgagttctcaataatggcgcgtttggtgcgaacttcgtggtaatcgaactccagcagcgagccgtcgctatcgatgccgcttatccccagaatgccgaaatcaaggcggaactgggagataaaatcgagcgtcgcttcgccaatgatcccgccatcgcggctgcgtaattcgccaccggcgagaatgatgcgaaaatcttcttttaccatcaacgtgttagcaacgttgagattgttggtgacaatgcgcaaattgctgtgattgagcagtgcgtgcgctaccgcttccggcgtggtgccgatatcgataaacagcgtcgagccattggggatttgctccgccactttgcgggcgatgcgctctttttcttcggtctgggtggccttgcgatcgtgccacggcgtgttaaccgaactggaaggcagcgccgcaccgccatgatggcgcaggatcaggttttgctccgccagctcattgaggtcgcggcgaatagtctgcgggctgacggagaaatgctctaccagctcttcggtactgacataaccctgctgtttaaccagttcgataataccgttgtgacgttgtgtttgtttcatttataaatccctggaattattttcgttttcgcgcattgagcgaatcaacaaaagccatcgctaaacccacggctaacccggcgatgtgtgctccgttcgccatcgacatcccaaacaaatcaaaccatccggcgacaatccagatcagcgcaaagataattaacccacgttgcaggtaaatgccactttgcggatcgcgttcgccacgtagccagacgtagcccatcagcgcatacaccacgccagaaagcccgccaaaccacggcccgctgaatttttgctgcacatagccgcttaacagggcgctgataagcgtaatgacaattagcttaccgctaccgaggcgtttttccaccgcaccgccgagataccaccaccagagcaggttaaagaggatatgcatcagcgagaagtgcattaacgcgtgggtgaagtaacgccagaactcaaatttcagtgttggatcgaatggccaggccagccataacatcacttcctgatcgccgagaatttgcatggcaataaacaccaccacgcaggcgatcatcatcacccaggttaccggacctgcgcgttcacgcaaggcggcaaagaaaggataacggcgataatgcaggccactgccggtatggcctgcctgccagctcgccgccagataacgcggatctgccgggttttcgagaaaacgcgccagctccgcccgtacgcgctcggcctgggactcatccgccagccagacatcgctttggttatgttgttgaatcgtgaggataacaccctgcgtcgccatgtaatcaacaaacgcctgcgccacgcgggggttagcaaaagaggtaatcatcaacatcgttgctgtcgcttattccacacaaaaggggacagtataaagcgttacgcgccgtacgccacctctgcgggaaactgacgttgccaggcttcaaagccgccgtcaatgctatagaccacatcgtagccctgttgcagcagatactgcgccgcgcctttgctgctattgccgtgataacacatcaccatcaccggagtgtcaaagtcgttatcacgcataaaagcgcccagcgtgtcgttggttaaatggaaagcctgcaccgcatgtcccattgcgaaactctgtggatcgcgaatatcgaccagcaccgcctctttttcctgcaacttctggtgcgcgtcggcaacgttaatacattcgaactgatccatgcgtctctctttctttacaaacaagtgggcaaatttaccgcacagtttacgtcgaagcggcagataaacgccataatgttatacatatcactctaaaatgttttttcaatgttacctaaagcgcgattctttgctaatatgttcgataacgaacatttatgagctttaacgaaagtgaatgagggcagcatggaaaccaaagatctgattgtgatagggggcggcatcaatggtgctggtatcgcggcagacgccgctggacgcggtttatccgtgctgatgctggaggcgcaggatctcgcttgcgcgacctcttccgccagttcaaaactcattcacggtggcctgcgctaccttgagcactatgaattccgcctggtcagcgaggcgctggctgaacgtgaagtgctgctgaaaatggccccgcatatcgccttcccgatgcgttttcgcctgccacatcgtccgcatctgcgcccggcgtggatgattcgcattggtctgtttatgtacgatcatctgggtaaacgcaccagcttgccgggatcaactggtttgcgttttggcgcaaattcagtgttaaaaccggaaattaagcgcggattcgaatattctgactgttgggtagacgacgcccgtctggtactcgccaacgcccagatggtggtgcgtaaaggcggcgaagtgcttactcggactcgcgccacctctgctcgccgcgaaaacggcctgtggattgtggaagcggaagatatcgataccggcaaaaaatatagctggcaagcgcgcggcttggttaacgccaccggcccgtgggtgaaacagttcttcgacgacgggatgcatctgccttcgccttatggcattcgcctgatcaaaggcagccatattgtggtgccgcgcgtgcatacccagaagcaagcctacattctgcaaaacgaagataaacgtattgtgttcgtgatcccgtggatggacgagttttccatcatcggcactaccgatgtcgagtacaaaggcgatccgaaagcggtgaagattgaagagagtgaaatcaattacctgctgaatgtgtataacacgcactttaaaaagcagttaagccgtgacgatatcgtctggacctactccggtgtgcgtccgctgtgtgatgatgagtccgactcgccgcaggctattacccgtgattacacccttgatattcatgatgaaaatggcaaagcaccgctgctgtcggtattcggcggtaagctgaccacctaccgaaaactggcggaacatgcgctggaaaaactaacgccgtattatcagggtattggcccggcatggacgaaagagagtgtgctaccgggtggcgccattgaaggcgaccgcgacgattatgccgctcgcctgcgccgccgctatccgttcctgactgaatcgctggcgcgtcattacgctcgcacttacggcagcaacagcgagctgctgctcggcaatgcgggaacggtaagcgatctcggggaagatttcggtcatgagttctacgaagcggagctgaaatacctggtggatcacgaatgggtccgccgcgccgacgacgccctgtggcgtcgcacaaaacaaggcatgtggctaaatgcggatcaacaatctcgtgtgagtcagtggctggtggagtatacgcagcagaggttatcgctggcgtcgtaaattaacgtaaggtgatcaggtcagatttcaatctggcctgagactgatgacaaacacaaaactgcctgatgcgctacgcttatcaggcctacgtggtttatgcaatatattgaatttgcatggtcttgtaggccagataagacgttcacgtcgcatccggcatgaacaaagcgcactttgtcaaaaatctaacctactttttaattcagggaattaccgcaaagcccacgccatcatacccaacgtaacaaaactcaggcacgttccccactcgccccgagaaaaatagcattaatgcgcccagcgccagcataaaaattttgagcagaaggtaaattgttggcgtgataaggatattacaaacttcaataataccggcaagtccgacacccagcatggcaataaccaccgccaaaaattgcgccagtatggggatgccgaaaaaagtcattaccagcgaggtcaaaatccattttctgttttgcattattctttccattctttttgaatggtgaaattatactccccgagtccccttgccccttctggacacttttccgaaatgatggcggaaaaaaacgggaccctttggccccgttctatttattggtgaacttacaatctcaccggatcgatatgccagatatgatcggcgtactctttgatagtacggtcagaagagaagtagcccatattggcaatgttcagcatcgcttttgcggtccactcttcctgaagctcgtagagttcatcgactttatcctgacaatcgacatagctgcgataatccgccagtacctggtagtgatcgccgaagttgatcagcgaatcaaccagatcgcgatagcgacccggatcttccggactgaatacaccgctgccgatttgcgtcagcacctgatgcagctcctcatctttctcgtagtattcacgcggtttgtagccctgacgacgcagttcttccacttcttccgctgtgttaccaaaaataaagatattgtcagcaccgacatgatccagcatctcgacattcgcaccgtccaacgtaccgatagtcagcgcaccgttaagcgcaaacttcatgttactggtgccggaagcttccgtccctgccagcgaaatctgttcagacagatctgccgccggaatgatcaactgcgccaggctaacgctgtagttcgggatgaacacgactttcagcttatcgccaatctgcggatcgttgttgatcactttcgctacgtcattgatcaaatgaataatgtgcttcgccatgtaataggccgaagccgccttaccgccaaaaatattcacgcgcggtacccacttcgcatccgggtcggccttgatgcggttatagcgggtaatcacatgcaacacattcatcaattgacgtttgtattcgtgaatacgtttgatttgtacatcgaacaacgcctttggattcaccaccacattcagctgctgggcgatatactctgccagacgctttttgttctccagcttcgcctgatgcacagcgtgattaaccattgggaaatcacagtgttgttgcagctcattaagcaggctaaggtcggtgcgccagttacggcccaggtgttcgtccagcacggctgaaagcgatgggttcgctaccgccagccagcgacgcggcgtcacaccgttggtgacgttggtgaaacgacccgggaagattttcgcaaagtcggcaaacaacgattgcaccatcagattagagtgcagttccgatacaccgttaactttgtggctcacaacaaccgccagccaggccatacgcacacgacgaccgttggattcatcaatgatcgacgcccgtcccagcagatcggtatcgttcggatactgttcctgcaaggttttcaggaaatagtcgttgatttcaaagatgatctgcaggtgacgcggcagaattttacccagcatatcaaccggccaggtttccagcgcctcgctcatcagcgtgtggttagtgtaggagaagacctgacaacacacctcaaacgcgtcgtcccagctaaattggtgctcatcgatcagcagacgcatcatctcaggaatcgacagtaccggatgggtatcattgagatgaatcgcgattttatccgccaggttatcgtaggttttatgcaactgataatggcggcttaaaatgtcctgaatggtcgaggaaaccaggaagtattcctgacgcaggcgcagctcacgcccggagtaggtggagtcatccggatacagtacgcgagatacgttctcggagtggtttttatcttccactgccgcgaagtagtcaccctggttgaatttaccgaggttaatttcgctactggcttgcgcactccacaaacgcagcgtgttggtcgcgtcggtgtcgtaaccagggattatctgatcgtaagcgactcccagaatctcttcggtttcaatccagcgcgtttttttaccttcctgctgaatgcgaccgccaaaacggactttatagcgcgtgttgtggcgtttgaattcccacgggttaccgtattccagccagtagtctggcgactctttctggctaccgttaacgatgttctgcttgaacataccgtagtcatagcggatgccgtaaccgcgccccggcaaccctaacgtcgccagagaatcaaggaagcaagccgccagacgtcccaggccaccgttaccgaggcctgggtcattttcttcatcaatcagctcttcgagatttaaccccatcgcttccagtgcgccctgtacatcttcgtaaattcctagcgacaacatggcgttggagagcgtacggccaatcaaaaactccatcgacaggtagtaaacctgacgagtttcttgcgacaactgggcacggtttgaacgtaaccagcgctccacgagacgatcgcgcacagcaaataacgttgcgttcagccattcatgtttattggcgacgaccgggtcctttccaatcgtaaacatcagcttgtaagcgatagagtgcttaagagcttctacgctaagcgtgggcgatgaatatgtaaacggagcattcatataggcgtttcctgaaaactatttcaagcgatagtaaagctcacggtacgacttcgccgcgacctgccagctaaaatccattgccatagcctgacgttgcacaaaccgccacagtgaaggacgggaccacagtacaaaagcacgtcgaatagcccgtaacagcgaccaggcattactatcttcaaagacaaacccactggcgacgccatctgcaaggttctcaagagaacagtcagaaaccgtatcagcaagcccaccggtgcgccgcactaacggcagcgtaccgtacttcaatccataaagttgcgttaagccgcacggttcaaaacggctgggcaccagaatgacgtccgcgccgcccataatgcgatgcgaaaatgcttcgtgatagccaatctgaacgcccacctgaccggggtattccgctgccgccgcaaggaaaccttcctgcagcaccggatcgcccgcgccgagtagcgccagctgcccgccctgctccagaagacccggtaaggcttccagcaccaggtcgagacctttctggctggtcagacggctcaccactgcaaaaagcggcactttatcgtcaaccttaagccccattgcgatttgtaactggcgcttattttccgctttatcttccaacgtatcgcgggtgtaacgcgaggccaacagtaagtccgtctctggactccagattttctcgtccacgccgttcagtacgccggaaagacgcccttcacggtgacgctgttgcaacagaccttccataccgtaggcaaactgcggttcggtgatctcgcgagcgtaggttggactgaccgccgtaatgtgatcggcatagtacagaccggccttcaggaaagagatttgtccgttgaattccagcccatgaatattaaagaatgaccatggcaattggatgtcattcatgtgatgtgcataaaacatgccttgataggccaggttgtgcacagtaaacaccgacttcgccggacgcccgcgcgccgccagatacgcaggcgcaaggcctgcatgccagtcgtgcgcatgcaccacatcaggacgccagaatgggtcaagcccgctggccatttctgccccaacccaccccagcagcgcaaaacgcaatacgttgtcggtataggcaaataagttggtatcgtgatacgggcttcccggacgatcatagagatgcggcgcgtcaatcaggtaaatgccaaccccgttgtaatgaccgaacaacagcgtgatatgtccggcgaaggtatcacgacgggatactacctgcgcatcggtcacgccacggcgaatatcgggaaatgcaggcaacagtacgcgagcgtcaacgccgtctgcgatttgtgctgcgggtaatgccccaataacatcagccagaccgccggttttaagcagcgggaacatctctgaacatacatgtaaaacctgcattatcgctcctgtttatgccctaacttccgtagcatttcgcgcgttaccagcacgatgccttcttctgaacgatagaaacgacgtgcatcttcctctgcgttttcaccaatcaccatgccttccggaataacacaagcacgatcgatgacgcagcggcgcagacggcacgagcgacctacccatacttccggtaacaatacggcggaatcaatgttgcagaatgaattcacgcgaacgcgcgagaacagaacggactgcaccaccaccgaaccggagatcacacaaccgccggaaaccagtgagttaagggtcatcccgtggctaccggagcgatcctgcacgaatttcgctggcggtaatgattcattgtaggtgcgaattggccaattgcgatcgtacatatccagttccggcaccacagaggccagatcgaggttcgctttccagtaagcttccagcgtacccacatcgcgccagtacggctcggcatccgggtcggattgtacgcaagagagcgggaacgggtgcgcataggccagaccggcttcggtgatcttgggaatcaaatctttgccaaagtcgtggctggagttctcatcgcgatcgtcttcttccagcagttcatacagatagtcggcgtcaaagacgtagatacccatactcgccagagatttgctcggatcgttcggcattgacggcgggttagcaggtttttcaacgaattcgataattttatcgttctcatcaaccgccataacgccaaatgcggaggcttcttcaatcggtactggcatacaagcaacggtgcaacgtgcgcctttttcgacgtgatcgataagcatacgcgagtagtcttgcttgtagatatggtcgcccgccaggatcaccacgtattccgctttataacggcggataatgtcgaggttttgggtgaccgcatctgcggtgccgcgataccagttttcccctttcattctctgctgtgctggcagcagatcgacaaactcgttcatttcttcattgaagaatgaccagccgcgctgaatgtgctgcaccagagtgtgggactggtactgggtgatcacgcccatacgacggatcccggagttgatgcagttagacagcgcaaagtcgataatgcggaacttaccgccgaagtgtacggccggttttgctcgcttattggttaaatccttcaggcgggtaccacgtcctcccgccagtatcagggcaacagatttcaatggcagctggcgcgccaacattaagtgatcgttcttctctaaactaaccatgactaactccttttttatcatctctggaacacacacaatccgtgtgcaggtccctgccagacagccgtaatcactgggttatcctctccagcgaatgggggaatggcgtgccactccccagcaggtaaaacaatctctgttacctcaagcgtggcgttaattgcgatcaaaaagcgatccgagagcagaatttgcagctgtttcggcccgttttgccactcatccgtgcttaaaggttgagcatatcgatttagccaacggacattgccgtcgccttcttcccaccagcgattctccaccaaagcgggaatgcgcttgcgcagatggattaacgcggcggtaaatgcggttaaaccactgcttgcctgcgaccagtccaaccaggttaattggttatcctgacagtaggcattgttattgccatgctggctgtgaccatgttcgtcaccggccagtaacatcggcgtaccctgggagagcaacaacgttgttaacagggcgtgaatgctgtcgcgccgccgttcaaccaggtcaagagaaccgcctaacccttctttaccatgattgttactgtaattgttgttggtcccgtcgcgattttcttctccgtttgcttcattgtgtttatggttgaagcaaacgcagtcgcgaagcgtaaaaccgtcatgcgcggtgacgagattaatcgcggcactcggcagacgaccattacgtttaaaaacatcgctggaggcagcaaaacgcccggcaaacgcccccagaggcaaatcataatgtagccagaaacgacgggcagcatcgcggaaatgatcgttccactcggcaaacagcggcgggaaatttcccacctgataaccaccaggagcgatatcccacggttcagcaattaacttcacctgcgagagcaccgggcagttctggatagcggtaaacaacggcgcatcctgacggaactctggcgtacggcccatgactgccgccagatcaaagcggaaaccatcgacgtggcaggtttctacccaataacgcaggcaggcgctggcataatccaccaccgccggatgactcaaattgagcgtgttgccgcaaccggtccagttgtgataatcgccgtcttctcttatccaataatagctacggttatcgatcccacgcagcgagaataacgggccgtcgaggtccagttccgcactatggttgagcacgatatcaagaatgacttcgatacccgctttatgcagtgctttgattgcatcgcgaaactcatccagcgccgtttctggcgagcaggcatacgccggatgcagcgcaaacatcgccaccgggttgtaaccccagtagttacttagccccatgcgttgcagacgtggttcactggcaaactgcgccactggcagcagttccagcgcggtaatgcccaattgtttcaaatagttgatcatcaccggatgcccgagggctttataagtgccacggatctcgaccgggatctccgggtgcaagtacgttaatcctttgacatgggcttcataaatgatggtgctgccccacggcgtgcgcggcggggcatcatcttcccagtcatagtgatcaaccaccactacgcatttcggcgcaatggcggcgttgtcgcgatagtcaggttcattatgaccggcgtgcagcagcgggttatctttaaactccccgtcaatttgccgcgcgcaaggatcaatcaacaacttcgccgggttaaagcgatgcccctcggcgggttgccaggggccatgaacgcgataaccataacgcaaacccgggcgcgcatccggcagataaccgtgccaaatgtcgccactgtgccctggcaagtcatagcgatgttcctggccattggcgtcaaagacacacagttctacccgctcggcatgagcggagaaaagtgtgaagttgacgccctgaccgtcgtaatgcgcgccgaggggagcgggtttgccaatggcgagttgtgtcattctgcctcccgaaccagccagatagtggccagcggtggtagcgtcaggcttagtgaatgctgacgaccgtggctggcaatctcatcgctgtgtaccgtgccgccattgcctgcattactgccgtgatagtgcatggaatcggtattgaggatttcacgccatttgcccggctggtttatgccgaagcgataatcatgacgcggtaccggcgtaaagttactggcaacgatgatttcgttaccctctttatcgcgacgcacaaagatcagcaccgagcgttctttgtcatccaccaccagccattcaaagccgtacgggtcaaaatccagttcatgcattgctttatggtggcggtaggtgaggttcagatcgcgcaccagacgctggacaccgtggtgccagttatcgccgccttccaacagatgccagtcgaggctggcgtcatggttccactcgcggccctgggcaaattcgttacccatgaacagtagtttcttgcccgggaatgcccacatccagccatagtaggcgcgcaggttcgcgaatttctgccatgcgtcgcccggcatgcggtcgagaatcgattttttaccgtggaccacttcatcatgcgacaacggcaggacgaagttttcagtgtagttgtagagaatcccgaaggtcagtttatcgtgatgatactgacgataaaccgggtcgagcttcatgtagtccagggtgtcatgcatccagccgaggttccacttgtaccagaagcccagaccgcccatatcctgcggacgagaaacgccagggaaatcggtagactcctcagccattgtcaccgcaccggaaacctgctcaccaagaatacggttggtattacgcaagaattcaatcgcttcaagattctcgcgcccgccaaattcgttcgggatccactccccctctttacggctgtagtcgcgataaatcattgacgccaccgcatcgacgcgcagcgcatcaataccaaaacgttcaatccagtaaagcgcgttaccgacgaggaagttactgacttcacggcgaccatagttgtagatcagcgtgttccagtcctgatgatagccttcacgcggatcgctgtgttcatacaagttcgtgccatcaaattcggcaagcgcaaagtcatcagtcgggaagtggcctggcacccagtcgagaatcacgttcagaccagctgcgtgtgcggcatcaatgaaataacggaagtcgtcgcgagtaccaaaacggcgggttggcgcatacaggccggttggctgataaccccaactgccatcgaagggatgctcgttaatgggcagtagttcgaggtgggtaaagcccatccatttagcataaggcaccagttgatcggccagctcgcggtagctcaaccagaaattgttgtcggtgtggcgacgccaggaacccaggtgaacttcataaatagagattggcgcatcaaactgattcgcttttttgcgctcttcagtctgtacaaccttttccggcagcccgcaaataagagacgcggtttccgggcgcatttgcgcttcaaaggcataagggtcggacttcagacgcaagttgccattggcatcaatcatctcgtatttatagagctgaccgttatgcgccccagggataaacagttcccagatgccgctctctttacgcaggcgcatcgggtgacggcgaccgtcccagtagttgaattgcccaaccaccgagacccgacgggcgtttggagcccagacagagaaacgcgtacctgtgacgccatccatagtatctgcatgcgcgcctaaggtttcatacgggcgcaggtgagtaccttcagataatagccaggcatccatttcctggattagcggaccaaaacggtaaggatcatcaatcaggttttgctgaccatgccagacaacagccaactgatagcggaaaaaattcttacgtcgcggaatgacgccgctaaagaatccccgtgagtcgagacactccagttttgcgagtttgcgcccggttttcggttcaatcacccacacatcggtagcgtcgggtaaaagggcacggacttccagtcccgcggtggttttatgcattcccagtacggaaaaaggatccgcaaaatggcctgcaattagcgcgttaatcacgtctctatcgatacgatcggacatgcttgtcttcctgttttattgtgtcaccccatccaattggatttttgacttctggttgtgacatttttttgacctgaacggcgcagcactctgtgcatcctctctgcgtcgtcctcacttcaggtaaggctgtgaatactcatgtattcagccacccttaaagaatagccaatgctctatttaactcccggtaaatcatgaaacatctgcgcttactcctgtattacgcactaacaggggcggcatcgcgccccagatttaatgaataaagattacgccagttgacgaagcatccgacgcagcggctccgcggccccccacagcagctggtcgcccacggtaaaggctgacaggaactctggtcccatattcagcttacgcaggcggcctaccggcgtggtcagcgtgccggtaacggcagctggggttagctcacgcatagtgatttcccgatcgttcggaacgactttcgcccacggattgtgcgcagccagcagttcttccacggtcggaatagacacatcttttttcaatttaatagtgaatgcctggctgtggcagcgcaatgccccgacacgcacacataaaccatctaccggaattacggaagatgtgttgaggatcttgttggtttccgcctgccctttccactcttcgcggctctgaccgttatcgagctgtttgtcgatccacggaatcaggctacccgccagcggcacgccaaagttatccaccggcagctcaccgctacgggttaaggttgtgactttgcgttcgatatcgagaatagcagaggacggggtcgcgagttcatctgccacatggccatacagatggcccatctgggttaataactcacgcatatgtcgcgcaccaccgccggaagcggcctggtaggttgcaacggacacccaatcaacaagatcattggcgaataaaccacccaacgacatcaacatcaggcttacggtacagttaccgccaacaaaagtcctgatgccattatttaatccgtcggtaatgacgtcctgattgacggggtcaagaatgatgatggcgtcatctttcatgcgcagagacgatgctgcgtcaatccagtaaccttgccatccgctttcacgaagctttggatagatttcgttggtataatcgccgccctgacaggtcacaatgatatcgagggcctttagcgcctccagatcaaaggcatcctgaagtgtgccagtggttccgccaaaagacggcgcagcctggccaagctgagaagtagaaaagaagacagggcgaatggcgtcgaagtcgcgctcttcaaccatgcgttgcatgagaacggagccgaccataccgcgccagccgataaaaccaacatttttcataagcgtttttttcctgcaaagatgtgtgctgtataaatgtgccggtctcctcttggcacatctttcaccatacaaaaagcagccaaagtcgcaagtgaaattaatcaatgatagcgaagccatcagtaatgcgacttatcctgctttgttagcacgcagaaagtccgcggcaattatcagggaatttgagttatgaatgaaatcatttctgcagcagttttattgatcctgattatggatccgctcggaaacctacctattttcatgtccgtactgaaacatactgaaccgaaaagacggcgggcaatcatggtgcgagagttgcttattgctctcctggtgatgctggtgttcctgtttgcgggtgagaaaattctggcatttcttagcctacgagcagaaaccgtctccatttctggcggcatcattctgtttctgatcgccattaaaatgattttccccagcgcttcaggaaatagcagcgggcttccggcaggtgaagagccatttatcgtgccgttggcaattccgttagtcgccgggccgactattctcgccacgctgatgttgttgtctcatcagtacccgaatcagatggggcatctggtgattgctctgctgctggcctggggcggcacctttgtcatcctgctacagtcttcgctatttttacgtctgctgggcgagaaaggggtgaacgcacttgaacgcctgatgggattgattctggtgatgatggcaacccagatgttcctcgacggcattcgaatgtggatgaaggggtaacgaggagagtttttcgaaaagaacccggtagcgtcacaactaccgggcgaacaaacttaactcaacagctggaacgcaatcatcccaacgatggcaccgacagtgccgaggatggtttccatcatggtccaggttttcagcgtttcggcttcggtcgcgccggtaaatttaccgaacaaccagaaaccggcgtcgttaacgtggctgacaacaatcgaaccaccagcgatacaaatcgacagcgccgccatttgcgcaccggagtagttcagttgttcaataaccggcatcaccagtcctaccgccgttaaacaggctacggtggcagaaccctgaatgatgcgcactgcagctgccagcacgaagcaggtgatagcaatcggcaggcccatgccggttaacgcttcgcccagtgccggacctacgccagagtcaaccagcacctgtttgaacacgccgcccgcaccaatcaccagcagaatgatccccgccggttgcagcgcgtgaccgcaaatctccatcactttgtcttttggcatgccctgacgcattgccagaccgtaaatcgccaccagacaagcaaccagaatcgcggtaaacggatgaccgataaactcaaaccattcgtaagcagttgatccttccggcacaaaacgcgcggcaatggttttcagccctaccagcaccagcggcagcaggatcagcgacaggctgaatccgaaagatggcattttgccttcgccgagatgcggttcgctgatgtcgtcaggaatatgcagctcaacgtaacggctgatgaagttaccccacagcggcccggcaataatcattcccggaattgccgcacacaggccaatcaggatcatccagccaaagtcggcattcatctgcgatgccagcagcatcggcgctggtccaggcaccagaaatgccgccgctgccgccacgcctgcaaataatgggattaccagcttcaccaggttcgtaccggtgtggcgcgccattgagaaagcaacgctaatcagcagaactatcgccacttcaaagaacagcggtagcgcacagaccagccccgcaaggccgatggcataatgcgcgcggctgtgaccgaaggatttgagcattttgacggcaatctgatcgactgcgccggtttcatgtaagatcttgccaaacatagctcccagggcgacaaccaccgccaggaagccgagggtgcctcccatccctttttccatcgtcgctgcgattttatcgagcggcataccagaaaaaaggccagcccccatggacaccaccattaaagccaggaaagcgtgcatacgcgccttcatgactaaaaacagcagcagtaaaacagaccctactgctgttaaaacaagcgttaatgtagtcactacttatttgccttttttaataacctcaatggtgcttgccacaacaccttccagcggttgatcgatatccaccaccagtacatcggtttcgtccgcacccggctcctgcagcgtttcaaactgcgtcaccaacatttgggttttaaagaaatggcctttgcgcgctttcaggcggctttcaatcacatcaaaatcgcctttcaaatagatgaaagagagattcggattaccttcacgcagcaagtcgcgatagtgttttttcaatgcagaacagacgatcagcgacactttattagtgcgctgcatagcaaacgcggcgtcgttcagcgcctgcaaccacggtttgcgatcgtcgtcattcagtggttcgccagacgccattttttcgatattgcgccgtggatggaggaaatcgccatcaagaaacgcggcatgaagttgatgcgccacttcactggcgaccgcagatttgccgctgcccgatacgcccatcaagacgtaaatgtggtgatcatggttagtcgtgctcaaagtggtgcccccacaatacaagaattaaaaatgttacgggtaactgttatcggtaacattgtccagccggacaatatcagaagcaatatccatccatgccttaagtgtataagtgtgagctacttcaaatttgtgggcttaaatagatccgcccggtgacaaggtgaaacctaaatctaacattttcggtgtcacagattcgccacgaatacgcgccagcaggcgttcagcgccaatactgcccatccgctcacgcggcgtcagcacgctcgcaagtcgtggctccatcacctgaccaatgtcatgaccgtggaaaccggcaatcgccatatcgtcaggaacttttaaccccagacgctgacattcaaacgccgcgccgaccgccaggtcatcattcgtacagaacacgccatccagctgcggatattcccgccgcgcctggcgaatcagttcaataccggaagagtaagaagaagattgctcaaccatcacgctatatggcaccaggcctgcatccagcatcgcctgttcgtatcccttctgtttgatgatagtacgttcgtcgagacgtgcgccgagataggcaatgtggcgatgcccgcgagcaataatggcagtggtcatctggcgtgctgcttcaaagttatcaaaaccgacggcgatatcaaggcatggcgacttgctgtccatcagttccaccacgggaatacccgccacttcaatcatctttaaggtgcgcggcgtgtgggtacgttcggtgaggatcaggccgtcgatattccaggagagcatggattcgaggcgttcttgctccatttccggtttataaccgtagtgcgccagcatggtctgataaccgtgcgcgtcggtgacgctttcgattccgcgtaatacttccgcgaaaacctggttggtgagagaaggtaacaggacgccaatcgcccggctggtggcgttagagaggatatcgggcgcacgattgggaatatagcccagttcatcaagagccgcggcaatcttgccgcgtagagcgacggaaacctgctccgggttgcgtaaaaaacggctgaccgtcattttggtcacgcctacacggtcagccacatcctgaagtacgggtcttttctttttcatcgtcctgaaggtacaaaagagatagattctcttagtttaacacggacacatcagaaccttcccggggaaaacagtgcttgtttacaattattagatatacactaaatcaattgcatcgcattgtgctaacgacgcggcaaaaccccggaagcgtacatcagcacgcgaccggagcgagcgaggaagcctgcaaaaaggcaggcttcaaagatgccgttgagttttaaaccggcggcagatcgaacagtaacacttcgctgtcgctatccgcatggatggagattgcctgctcatcccagattgccagaccatcgctggtcgaggctttcacgccgttaatggtgacattgcctttcaccacctggatccagacgcggcgttcagcggcaatctgatgcaccgactgctcatctttcagcaacgcccagcggtacagttccatatcctgatgcactttcaatgaaccatctcgcgcatccggcgagagcaccagctgtttgccctgtacggcatcgaagcgacgctgttcataacgcggcgtaataccgttttcttcaggcatgatccagatctgatacagatgcagacgctcggtgctgcttgggttgtactctgagtgacgaatacccgtaccagcactcataatctggaactcacccgccggaacctgctctttattgcccatgctgtcctgatgctcaacagtaccttccagcacgtaggtcaaaatttccatatctttatgcgggtgagtgccgaagccctgccctgcttcaatcacgtcgtcgttaatcacgcgcagcgcggagaagcccataaagttcggatcgtaatagttggcaaaagagaaagtatgccaggagtccagccagccatgatttgcatgaccacgttcatttgctttgcgtaagtagatcatttgtattcgccccctgaatgatttcgatgggcttagtgtggacccgatctgcctgggatgatagagggtgaaaattgacccctctgttcaaaaaaattgaactattcgaggggccatcaaacttacttagcgagagttactgtggagggagaggcttgctcaaatccgcgttcaaggatttccagattggtaagaacttcagattccttgacgtaatttggcgcaccgtgggtgatggtttgatacaacgcatcataaacgcgcccgtaatcgcccatctccggcttcatctcttctctgaccgtcacgccctcgtcattgacatactccagcacaccgaccgaatcatccgctgcgaatcccggttcgcccggcataatattagccttcaggctggtttcctgctggtcgataccgtatttaataaacgaacctttcttaccgtgaacgataaatttcggataatcgattttcaccagatggctggttttgacgatggctttcaggtcgccataaaacagttgcgcttcaaaggtgtcgtcaggattggctttattacgcaggctgcggatgtcataagcgacgtgatccgggcgaccgaacagagaaataatctggtccatcgtatgcacaccaaggccataaaacgcgccatcctgcggcagcccaggtttggtttctgccaccgggcggtaatagtcaaaatggctttccacttcaacaatctctcccaacttgccactttcaatcgcttttttcgctgtcaggaagcaggagtcaaagcgacgattctgatacggcgtgacggtcagccctttgcttttcgccaacgcaaacagctctttcgcctgcgcaagtgtcggagtgaacggtttttcgaccagcacatttttcccggcttccagcgcgcgtttcgcgtactcgaaatggctgtccgcgtgggtgcagacaacaaccagcttaacatcgggatcgtttagtacttcgtcgagatcgctggtgaaatggatatgggaataaatgggagcctgttcttccggcttcgcatggcgacgaaaaatatgcgcgacatgccagctatccttgcggttaagtacatacggcagatggtaacgggtggtgcttttgccgaagccaataaaggcgcagttgatgaccatgatttcgtcctttttaaggtggttatttacaccttagcgcaaagcggacgtggttcctactggagtgcgcataacgaacacaagcactcccgtggataaattgagaacgaaagatcaaaaaaaaagccagcacccggctggctaagtaatactggaagcaatgtgagcaatgtcgtgctttcaggttctccgcgagggtcttcctgatcgcgagacaataataatcattctcattcgcacttgtccaacactttttgcaaaaaaatgcatttgactcgcatttgaaagtcaatgatgttgaaagggacatttaccccaaagaggacaaaggaatgagtgagatagtaatacgccacgcagaaacacgggattacgaggccatcaggcagattcacgcccagccggaggtgtattgcaacacactacaggtgcctcatccttccgatcatatgtggcaggagcgactcgccgatcgtcccggcatcaagcaactcgtcgcctgtattgatggagacgtcgtgggccatctcaccattgacgtgcaacagcgcccacgccgcagtcatgttgccgattttggtatctgtgtcgactctcgttggaagaaccgcggcgtcgccagcgccctgatgcgagagatgattgaaatgtgcgacaactggttgcgggtagatcgcattgaactaaccgtgtttgtcgataacgccccggcaattaaggtctataaaaaatacggctttgaaattgaagggactggtaagaagtacgcattgcgtaatggtgaatatgtcgatgcatattatatggcgcgggtgaagtaagatagtgccctttttctgagatggaaaaagggtgtcattcaaaatcgacataccttcctttaaggtatttatttgcccaatacatatattgagatttaactcataattacttcctaaagtgtaatattttattttttaatatatacgcctacaatttcctggagtaaataaataacaattaacaagcataatattgccattgataaaatagcatgccataaaaggacttttcagggatgagtaatattgtttacctgacagtaacgggagaacaacaaggaagcatctccgcaggttgtgggacttctgagtctacaggtaatcgttggcagagcgggcatgaggatgaaatatttacattctcactcttaaataatattaataatacggggcttggttcacagttccatggtataacattttgtaaattaattgataaaagcactccattatttattaattccattaacaataatgaacaattatttatgggatttgacttctatcgaataaatagatttggtagattggaaaagtattattatatacaactaagaggcgcttttttatcggctattcatcaccagatcattgaaaaccaactggatacagaaacaataactattagttatgaatttatcctctgtcaacatcttatcgcaaataccgagttcagctatttggcactccctgaaaattataaccgtttgtttttaccaaattcaaaaaaccaaacaaataatcgtttcaaaacgttaaacagcaaagctattggcaggctacttgctgctggtggcgtatacaatgggaacattgaaggattcagagatactgcggaaaaactgggtggagatgcaataaaaggctatgatcaaatactaaatgaaaaaacagcgggcatagcgatagcaacagcatctattcttttaacaaagcgttctaatgttgatacatatacagaaataaatagttacttaggcaaacttagaggtcaacaaaaacttcttgatggtatagacataatagaaataatatacattaagagaccttcaaaagacttagctaacttacgaaaggagtttaataaaactgtaagaaaaaattttcttatcaaacttgcaaaaacctccgaagcatctggaagattcaacgccgaagaccttttaagaatgagaaagggcaatgttcctctaaattataatgttcaccataaactatctctagatgatggtggtactaatgatttcgaaaatttagtattaatcgaaaacgaaccatatcataaagtttttactaacatgcaatcacgaatagctaagggaatattagtaggtgaaagcaaaatcactccctgggccattccatctggctcaatttatcctcccatgaaaaatattatggaccacacaaaatgatgactaaaacccaaataaataaattaataaaaatgatgaatgatttagactatccatttgaagcaccgctcaaggaatcatttattgaaagtataatccaaatagaatttaattctaattcaactaattgcctggagaagttatgtaatgaagttagtattctttttaagaatcaacctgattatcttacttttttaagagcaatggatggattcgaagttaatggattacgattatttagcctctcgattccagaaccttcagttaaaaacctttttgccgtaaatgaattttatagaaataatgatgatttcataaaccctgatctacaagaacggttagtgatcggggattatagcatttcaatatttacttatgacattaaaggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattaccgacattaaaagtaacttttttgaaattagagataatattggcacagaaaatatattcagttcgtttagtgatttctcttcattcttaaacgaaatcatggacagttgttcataataatcaaaaggaaacaaaaatcattgtaaaccatgccatctttttagagattaccagcagaaaattccttgttcgaaatttagcagtgcaagctatggaaaaacttacaacggaactacactccttaagtgagatggaccgaagacatgtagtctctattttagccgaaatagctaatggctatgatgattttaatgacatgttgatttatttagaattttacccgaatcataagattctgatatcttaaataagaaaatcccgttcgacgttctgaaaaagaaatcataaaatattagcagatacttatttcgtgactatatcttatccgatgaacttttttcaaaaccagcatttaataatatctttgacgaagatgaacgcgtctttgctcaatgtatcacacaggaataataatataacactcaacaataatatttattataattatgattacttatcacgacgcattcgcgaaagcgaaccattaccttgatgatgcagatctcccggtcgtcattactctacatggacgctttagccagggctggtatttctgtttcgaagcacgagaatttctcgaaactggagatgaggccgcgcgcttagctggtaacgcaccttttattattgataaagacagtggtgaaattcattctctgggaacggcaaaaccgctggaagaatatctacaggattacgaaataaaaaaggctaccttcggcttgccctgacaaaatagccctcttcccacgaagagggccgctaaccttagtaccccgccgttaaatcatccaccgagcgcgggtcggatgcgccgtacaactcaccgtccggcccaaccataatgctttgtgtactgcccatcgcctctttcagcgccactttctgaccttttgcttccagcagcttgagcgtatccgggctaaaccctttttcgacacgcagctcgtccggcaaccactgatggtggaaacgcggcgcattggtcgcttcggcgacgttcaagccataatcgatgctattcaccaccatttgcagcactgtagtgatgatccggctaccgcctgggctaccggtaaccagccaggttttaccgtctttcaccacaatggtcggcgacatcgacgacagcgggcgtttgttcggcccgacggcgttggcatcaccgcccaccagcccgtaaacgttcggtacgcccggtttggcggagaaatcatccatctggttattaagcagaataccgctctcgcccgcgacaatgcccgtaccgaaggtggtgttcagcgtataggtcaccgccaccgcgttaccatctttatccaccactgagtaatgggtagtttgattactctcataaggcgcaagcttgccggggcgaatttcgctggatggcttcgctttattgatatcaatttgatcggcaatagatttggcataggctttattggtcagcgcctgccacggtactttgacaaaatccgggtcgccaagatattccgagcggtcggcgtaggcgtatttctccgcttctgccatgatttgcatcgcatcggcgctgccaaagccgtatttcttcatatcgaagttttccagaatattgaggatttgtacgatatggatcccgccggaggatggcggtggcatggagtaaacctgatacccgcgataatcgccgcttatcggagtgcgttcgaccgctttataggctgctaaatcttctttagtgatcaagccaccgtttttctgcatctcctgggcgatctgttccgcaatcgtgcctttatagaattcgtccgggccgttttcagcaatcatctccaggctctttgccaggttcgcctgcaccagcgtgtcgccctttttcagcggctcgccctctttccagaagatagctttactgttttcgtgattcggcaacacttcgctaccgtaggttttgagatcgtcagccagcgcgtcgttaacgataaaaccatcgcgtgccagtttaaacgcgggctgcacgactttgttcagcggcatggtgccgtatttatccagcgccagcgagaaacctgctaccgtacccggtgtgccggaagccagatgcgaagtgagtgattttttgctgtccgggttgccctgatcatcgaggaacatatcgcgggtcgctttggcgggtgccatttcgcggaaatcgatagccgtggtattgccatttttcgagcggattaacataaaaccaccaccgcccagattccctgcctgcggatgcgttaccgccagcgcgtagcccaccgccacggcggcatcaacggcattcccgccctccttgagaatatccacccccacctgagtggcagtggcgtccacagacgctaccattccctgtttcgcgcgtaccgggtggaagacatcttcctccacaccatacgagacgggcggcgcaggaggcgcggcggcggcgctaaaacaacttcctgagagcagagcagcaatggccacccggcgtaaaaacgtcggttttatcatcgttattctccagagattaaggggcaaccccagctaagcctggtatataactctgaattaatcatcgttttgtcgggaagcgagtaaacttaaaggatatcttcagaggaggatacgcgatgaaacgacttctgattcttacggcactcctgccgtttgtcggctttgcacagcccattaatactctgaacaaccctaaccagccggggtatcagatacccagccagcagcggatgcaaacccagatgcagactcagcaaatccagcaaaaagggatgctgaatcagcaactgaaaacgcaaactcagttgcaacagcagcatttagaaaaccagataaacaataattctcagcgggtgttgcagtcacagccgggggagcgaaatcccgcccggcagcaaatgctgcccaacaccaacggcgggatgttaaacagcaaccgtaatccggatagttcgttgaatcagcagcatatgctgccggagaggagaaacggcgacatgctgaatcagcccagcacgccgcagcctgacattccgttgaaaactattgggccgtaaagttcggaccaatcacgtcaatcgcatcggtacagatgcaatccacaccccagcgcagcaactctgctgcgcgctggggtttattgacggtataaaccagaatccgcagtccggcgtctttcaactgcatcactcgcgctttattgagtaacttatgattgagatgaatagagacgcagcccagccgcgcggtcagttcgcgccagtcgtcgcgccactcatccagcaacaaaccgcgcggcagttccggtgccgcctgttgtgcagcttctaaagcatcaatctcaaacgatgacagcagcggcggcgtcataccggcccacagctcgcgtgccgccagcgccaccattttgcccgttaatggcccggtgccggtggtgggtttgatttcgatattcgccatcatcccgtgttcgcggcaacgttccgccacctgcgaaagcaacggtagcggctcacctttaaacattttgctgtaccaactgcccgcatccacgcgcagtaaatcctgccagttcagttcacccgcgacgccccagccgttgctggtacgttcgagattgtcgtcatggagcaggaagatctcgccatctttcgataacttcgcgtcaaattcgatcatcttatgaccgtattttgccccgacgtcgattgacgccagggtgttttccggggccagcttaccgccgccacgatgagcgacgatgcggggataaggccagttactcatactcgttgtcctgtttcaccatcaaaaagatgcagctgattttccgccagatgcagccacagcgtgctgcctgccgtcgggcgctcctgatgcgccagtcgcaccaccagcttctgctcgccccagcgtccgtgcgccaggttatctgcgccgaggatctccagcgtgtccatcaccatcggtacgccgccttctgcctgcgagcttagcgcaatatgttccgggcgaatgccgagagtcattttacgcccggcatactgacggtagccaccgtttagcggcagctcaataccgccgtccagttcgaaatgcgtgccttcgttattcacgcggcctgtcagcaggttcatcgccggactgccgataaaactcgctacaaacaggctggcgggcttttcgtagacttcaactggtgtgccaatctgttcggcaacaccgccgttcatcaccattactcgctgggcgagcgtcatcgcttcaacctgatcgtgagtaacgtagagtgaagtcgttttcaggcgacggtgcaactgttgcagttcaagacgcatctgcacgcgcagcttggcatcgaggttagagagcggctcatcaaacaggaacaccgccggatcgcgcacaatcgcgcggcccatcgccacacgctggcgctgaccgccggaaagctcgcgcgggcgacgtttgagcagaccgtccagctccagaatgcgcgccgcttctttaacgcgctcggcaatttgctgcttgcccatgccgcgaattttcagcccccacgccatgttttcttcgacactcatatgcggataaagcgcgtagttctggaacaccatcgcaatcccgcgatcttttggctccatttcagtcacgcgctggtcgttgatccagatatcgccttctgtcacccgctccagcccggcaaccatgcgcagcagcgtcgatttcccgcagccagacggcccgaccatcacgataaattcgccatccgccacatcaagggtcagcggtttaatgacctgggttttaccatcccagcttttggttactgcctgtaatttcagtcctgccatcttatttctcactatcgaccaggccgcgcacgaaggcacgctgcatcactaaaacaatcaccaccggagggataagcgttaacaacatcgccaccatcactgagttccattccgtggtgccttcgcctgtagcgatcatccctttgatccctgccacggtggtgccgagatccacatcggtaataatcaacaacggccacaaatactgattccagccgtagataaaggtgatcacaaacagcgccgccagattagttttggagagcggaaaaacgatgtcgcaaaagaagcgcattggcgatgcgccgtcgatccgcgcggcttccaccagctcatccggcagcgtcataaagaactggcggaacaggaaagtagcggtcgccgaggccatcagcggcagcgttaaaccggcgtagctgtcgagcatctgcaggttggcgatgacttccaccgtcgggaagatacgtacttcaaccggcagcatcagggtgataaaaatcatccagaagaagaggttacgtagcggaaaacgaaaccagacaatggcaaatgccgagagcatcgagacggtaattttgccgagcgtaatgctgaacgccatcacaaagctgttaagcaacatccgccagaacggcgcgctattcgtgcctaccccgttcacccagatgttgtggatgttttccagcagatgtgtgccggggatgagcgtcatcggcgcggcatagacggcctgtttatccagcgtcgccgcgacaaacgccacgtacagcgggaagaggatcaccgcgatcccgaggatcagcatggtatggctgaatatcgtcagccacggacggttctcaatcattggtaacgcaccttgctttcaacatagcggaactgcaccaccgtcagcacgatgacgaggaacatcaacaccaccgactgtgcggcagacgaagccagatccagtccggtaaaaccttcgcggtagatcttataaatcagcgtcgtggtggcctgaaccggcccgccggacgtggcggcgtcgatcaccgggaaggtgtcgaagaaggcatacaccaggttcactaccagcaggaagaaactcaccggggcgataagcggcagcgcaatcttaaagaagcggcgaatcggccctgcaccgtcgatggctgcggcttcgatcaacgaacggggaatggattgcagcgcggcatagaagaacaggaagttgtagctgatttgcttccatactgaggcaaacaccaccagaaacattgcctgaccgctgttttgcgcgtggttccagtcgtagccgaactccgcgagaaaatgggtgatcagcccgcgaccggggttaaacaggaagatccacaatacggcggcaacggcgggagccacggcgtaaggcagcaacattaaggtttgatagaaacggctgccgcgcacgatgtactccaccagcgccgcaaagaacagcgataccagcaaaccgctgacggtgacaaaggtgctgaattttatcgtcgtccagaaggagtcgagatagtagctgtcatggaacagcgtgacgaagttatccaggccgacaaactggctggagaaaccaaacggatcgacgctttgtagcgagtaccacaacgcttcgcccgcaggccagataaaaaagataacggtgatgatgagctgcggcgcgaccagcagataaggcagccagcgcgagcggaacaccggacgggatgatgacattacggttaattcctgaactgtgccggatgcgcttcgcttatccggcctacacgcgatgccaggtcagataagcgaaacgcatccgacattacactgattaagacttcgtcgatttctcaaagcggcgcagcaactgatttccacgctcaacggcggtatccagtgcctgctgtggtgtcttcttaccggtccacacgctctccagctcttcatccacaatcacgcggatctgcggcatgttgcccagacgcagccctttggtgaacggcaacggcggcttattcagcatctgacgcgtcgcggtatccgcccctgggtttttctcataaaagccctgctcacgggtcaggtcatacgctgctttggtgattggcagataaccggttttctgatgccactcggcagcgttttctggcttcgcgaggaaatcgaggaacttcgccacaccggtatacgtttctttatctttaccctgcatcacccacaggctggctccgccgataatggcgttttgtggcgcatctttcgcatcggcgtcgtaaggcatcatgcctacgccgtagttaaatttggcgtactcgcgaatgttggcaagagaaccggaagaggcggtggtcatcgcgcaatcaccgttatagaacttctcggtggattcatccttacgaccgacgtagctgaagtcgcccttcttgttcatctcctcgagcatggcgatgtgtttcacctgctccggcttattgaactccagcaccgcgtccgtgccgtcaaagccgttgtttttgctggcaaacggcagaccgttccaggcgctaaagttttccagttggatccagccctgccagccgctggcgtagccgcacttcatgccggaggctttcagtttcgcggcatagtccgccagatcctgccaggttttcggcggctgttccgggtctaatcctgctttcttgaaggcgtctttgttgtaatagagaacgggggtcgagctgttgaatggctgggagagtaagtggcccgttttgctgtcggagtagtaacctgaaaccgtcggcacaaactgcgactcatcgaactgaatccctgcctctttaaacacgtcatacaccggtttaatggctttcgacgccatcatggtggcggtgccaacttcataaacctgcaaaatagccggcgcgttgccggtacgaaatgcggcaatccccgcgcttaaattctgttcgtagttgcctttataggtcggtacaattttgtaatccgggttttcggcgttaaaacgttgggccagagaatccacctctttacccagttccccttccatagaatgccagaacggaatggtcgtcactgcctgtgcattccccattaacgccagtccgagcgccagtgctgaagctgtataatgtaacggtttcatcgtttatctctcttgttgtaccgaatgcgcgaattcacgcgttttatgctcgcggggtaacatgacatgctcgaattacagaaaaataacttttttgttacatttgtaagatagtaaggtgtcagaaagatgacaaggcggtgacggcgtgggtgagggaaaatgggagatggggcacggataagcgggaaaatatagaaggtctgaatcaaactctacagattgctcatcgtttcatgccggatgcggcgtaaacgccttatcaggcctacaagatcgtgcaaattcaacatattgccactcacccagtaggcctgataagcgcagcgcatcaggcaattttacatttgtcacctgtctcaaaggagtcttttgactccctatcaatcaacgtgttattacccgcctaaatacgcacttctcaccgcttcattcgccagcagcgcatcaccagtatcggaaagcactacatggccgttttccagcacgtagccgcgatccgccagctttagcgcctggttggcgttctgctcgacgagaaagatagtcatcccctgctcgcgcagctgctcgatggtgtcgaaaatttgctggatgataatcggcgcaagaccgagcgatggctcatcaagcagtagcaaacgcgggttgctcatcagcgcacgaccaatcgccagcatctgctgttcaccgccggacatggtgcccgcccgctgaatacggcgctcatgcagacgtggaaacagctcatacacccactttatgcgctcctggaactggtcgcgttcagcaaaaaaaccgcccatcgccaggttctcttccaccgtcatccgcgagaagacgcgacgcccttccgggacaatcgccaccgcttcgcgcatgattttcgctgtctgccagtcggtaatgtctttatcatcaaacacaattcgcccgctggtggcacgcggatcgccgcataacgtgccgagcaaggtggttttccccgccccgttcgcgccaatcagcgtgacaatctcgccctgattgatatgcaggctcacctcatgcagcgcctggattttgccgtagtgggcgctgactttgtcaaaggacaacatgactttttccatcttatgcctcacctaaataggcacggatcacgtccgggttattacggatctgctccggcgtaccgtttgccagcggcgtcccctgattgaccacgtaaattcggtccgaaattcccatcaccagcttcatatcgtgttcaatcaacaagatagtggtgttgtgatgattgcgcagttcggcaatcagctcatccagctctttcgtctctttcgggttaagacctgccgcaggttcgtcgagcattaaaatctccggctgcgtcaccatgcagcgggcaatctcaagacggcgctggtcaccataggccaggttactcgcctgacggttggcgtgttccagcaaaccaatgcgctcaagccaggtcgcggcgcggtcgagcgcttcgctctgggcgcgacggaaggatggcgttttcaacaggccagagaacagcccggttttcagttgctgatgctgcgccaccagcaggttttcaattaccgtcatttcacggaacagacgcacatgctggaaggtgcgcaccacgcccatgcgggcaatttgctgccccggtaaaccttccaggtgctgatcgcgcagtaaaatggtgccgccggtgggtttgtagaatccggtcagacagttaaaaaccgtggtttttccggcaccgttagggccgattaacgagacgatctcctgcgggtacagttcaagattgacgttgttcaccgccagcaggccgccgaagcgcatcatcaggccgttaacagataataatggctgactcatgcctgctctcctttcgctgcgccgtttttcagcttcagttgcgggcgcgtcatgggcagcaagccctgcggacgccagatcatcatcagcaccatcaaaccaccgagcattaacatgctgtattcgttgaaatcacgcatcaactcgcgcgacaccaccagcaaaattgccgccagaatcaccgcaaattgcgagcccataccgccgagcaccactatcgccagcacaaacgccgattcggcaaaggtgaaggattccgggctgacaaagccctgacgcgccgcaaacagcgttccggcaaaaccggcaaacgcggcacttatggtaaaggcagtcagcttgatacgacgcgggcttaagcccagcgaacggcaggcgatttcatcttcacgcaacgcttcccacgcacgccccagcggcatccgcagcaggcggttaatgacaaacaggcttagcaccaccagcagcaacgccaccaggtagaggaagatgacacgatcggagggatcgtatttcaggccaaagaaattactgaacgtgtcccagccgccttcacgagcggtacggctgaactcgagtccgaagagtgtcggtttcgggatctgactgattccgttcgggccgccggtaatttcggtgttattgagcagcaatatgcgcacaatttcgccgaaaccgagggtaacgatcgccagatagtcaccgcgcaaacgcagcaccggaaaaccgagcaggaagcccgccgccgctgccattaatccagcaatcggcaggcaggtccagaagcccaagccgtaatagtgattgagcagcgcaaaagtgtaagcgccgatggcgtaaaaaccgccgtaccccagcaccagcagaccagaaagaccaacaaccacgttcagcccgagaccgaggataatgtagatcatggtcagggtggcaatatccaccgtcccgcgtgaaaccataaacggccacgccaccgcaagcaccaacagcgccacgaggaacagtttctgcttcaccgtggagccatcaatggcgggcagaataaacttcggtccggaaacgcttttcaaccctttctggaaagccggtcgcaaaagctggaagaaaaagaccaccgccgtgccgataaacacccactgccaacggacatccgaagccgtgtcgaccaccagtttggtgccatccagctccagttgcacgcccataaagacgcccgccagcacaaagaacatcgcggcagagagcagcgccattgcaatatgcatcggtttcatactttctctacctccgggcgacccagaataccggtcggcatcaccagcagcaccagaatcagcagggcgaatgagaccacatctttatattccgtactcagataggcagaagagagcgcctccgcaatccccagaatcaggccgccaatcatcgctcccggaatgctgccaatcccaccgagcaccgccgcggtaaaggctttcatcccggccataaagccgatgtaggggttaatgacgccgtagaactgaccgagcagcacacccgccaccgccgccatcgccgcgccaatcacaaaggtcagcgcaatcacccggtcggtgttaatgccaagcagactcgccattttcagatcttccgcgcaggcacgacacgcgcgacccatgcgggaatagcgaatgaaaatcgtcagcgccagcatggcgaggaaggtaacaatccagatcaccgcctgcatggtggtaatagaggcagagaagttttcgctatgccccaccacccactgaccgttaaacaggctcggcagcgccacgtcgcgcgaaccttcggtcaggctgacgtagttttgcaggaagatggacataccgattgcagagatgagtgcaatcaggcgcttagagttacgcaccgggcggtaagccacccgttcgatactccagccgtaggcgctggcaatgacgattgcgccgacgaatcccgcagctaccagcagccagccggtatcaatgcccatcatcatcagcgcggcgatgatcataaatgagacgtagctgccaatcatataaacctcgccgtgggcgaagttgatcatgccgataatgccgtaaaccatggtgtagccgatggctatcagcgcgtaggtactgcccagcgtgacgccgttaaacatctgctgcaagaaatacaaaaactgctcagacataaggtaacctttctaaacccgcccgcattttacgggcggtgggatgatcacttggctgccgtggatgaaccgtcggcgtgccactggaagacaccaaaatcaaatcccttaagatcgcctttttcatcccagttcagcggcccaatcacggtgtttgcaccgttagcttttaaatctttcaccagcgccagcggctcatcgctgccggtacgctcaagggcagtcgccagagattgcaccgccgcgtaggtgatccagacataaggcccggacggatctttcttgtctgctttcagcgcatcaacgatgccctggtttgccggatcctggtcatagcgttttggcatagtgaccaacatgccttcggcggcatcaccggcaatgttcgacaacgacgcattacccacaccttccggccccataaactgggttttcaggccaacggaacgggcctggcgcagcatctgccccatttccgggtagtaaccgccgtagtaaacgaagtcgatgttttcttttttcaggcgggcgatcagcgcggagaaatctttctccccggcggtaataccgtcgaagaagacgacgttggcgttagccgctttcagcccgtcctgcaccgaacgcgccagcccttcgccatactgttgtttgtcgtgaatgatggcgatgcgctggggcttcaccgtctcaagaatgtattttgccgccgttggcccctgggaagagtccagcccggcagtacgcataatgtgttgataaccgcgttgggtcagctccgggttggtcgctcccggcgagatcatcagaataccttcgtcttcatagatatctgacgcaggctgggtagaagaagaacacagatgaccaataacgtatttaatgccgtcattaacgattttgttggcgaccgcaacggcttgtttcgggtcgcatgcgtcgtcatattccacgccaaccagtttatcgcccttaattccccctttggcattaatgtctttaattgcctgacgcgcgccgttaaattccatatcgccccactgggcaatcgggccggacatcgcgccgacaacggcgactttaatatcgtcagccatagcggtgtgtgaaattgccagtgcaatcatccctgcgatgatagttttcgcattccgtttcatagtcaaaaatccccattcgtgatgttgtgttgctttgtttttatgtgttaacaaatcagactgttctttttttatactgcactgtttttgcctgtctgattaaggggttagcgcagtattttgtgataatagcgattaaaatccctatttttcagtcgattaagaacagataatattctgaatttattgatagataaacagaaaaaagtgcctttgtcagcataaaataacggcacaaagggcggaataattcactatcattcaggggattatgctggacatttttcattctctaatgttttaattttgtaattattgctgttaaaaaattaatcacctgccaaaagaaataaaaaagagaaagcctccgattaaattatttcgctacactggttccacttttgtgatttacacgggttacccatgaagctgaccatcattcgattagaaaaatttagcgaccaagaccggattgacctgcaaaagatctggccggagtattccccttcctcgttacaggttgacgataaccaccgtatctacgccgcgcgttttaacgagcgcctgctcgctgccgtgcgggtaaccttaagcggcaccgagggagcactggattccctgcgcgtgcgggaagtcacccgccgtcgcggtgtggggcaatatctgctggaagaggttttgcgtaacaatcctggcgtttcatgctggtggatggcggatgcaggcgtggaagatcgcggtgtgatgacggcgtttatgcaggcgctggggtttacggcacaacagggcggctgggagaagtgttaatcgtcaagtttgatttcaaaagtgatattgcctgatgcgctacgcttatcaggcctacaatgtgtgttgcaatttactgatttctttggatcttgtaggccggataaggcgtttacgccgcatccggcatgaagcaacgtactcgatattagcaatttggcggcaacccaaagttgccgattaatgattacttcgcatcggtcgccgtgccgttggcgtgccagtcaaatacgccgaactcaaagcctttcagatcgcctttctcatcccaggtcagcggtcccattacggtatccacggagttcgctttcaggtatttggcgatttcagccggatcgtcagactgattcaggcccgcctgcaaagattgcagcgcggcgtaggtggtccaaacgaatgcgccacttgggtcctgttttttcgctttgatcgcgtcaacaatgggtttgttcgccggaacctgatcgtagttcttcggcttggtcaccagcagcccttccgctgattcgcccgcaatgttagacagcgaaacgttagccacaccttccggccccataaactgagttttcagccctgccgcgcgtgcctgacgcaggatttgccccatttccgggtgataaccgccgtagtaaacgaagtcgatattctcttttttcagacgcgccaccagcgttgagaaatctttttccccggcggtgatgccatcaaagaacaccacgtttgcattgcctttcttcaggccgtcctgcaccgctcgcgccagaccttcgccgtattgctgtttgtcgtgaacgatagcaatacgctgcggtttcactttctcaagaatatatttcgccgccgtcggcccctggtcggagtccaggccggtggtgcgcaggatcagctgatagccacgggcggtcagctccggcgcggttgccgctggggtgatcattaaaatgccttcgtcttcgtagatgtcagacgcaggctgcgttgatgaagaacagaggtgaccaatcacatatttaatgccgtcgttaacgactttgttcgccaccgcaaccgcctgtttcgggtcacaggcatcgtcatattttacgatttgcagtttgttgcctttaatgccgcctttagcgttgatatccgcaaccgcctgctctgcgccggtaaactcctggtcaccgtactgcgcaaccggaccggacattgcgcccacgaccgcgactttaatatcttctgccagagccatattgctgaatgccagcgcgatacatcctgccagtaacgctttaccctttatgttcatcctgagaatccccattcttctggttattacgtgtgttgtgatgttgtttttcagcactttatttcgttttatgcatgactacccgtgctttagcagcatactctgctaaaacatacccgatttttatgatattggaatagctattttgacagtttattaacaatctgcgtggggattggcgttttgccggaggggaaattgattattacagaggcccaaaaaacaaaaaccccggactctcatccagggttctctgcttaatagcggaaattacgcttcaatggcagcacgcaattttttcatcgcgttcttttccagctggcgtacacgctcagcggaaacgccgtaacggtcagccagttcctgcaacgtggacttgttgtcttcgtccagccagcgcgcacggatgatgtcctggctgcgttcgtccagaccctgcatcgcgtcggtcagacggtttgccgcctgctcttcccagttatcatcttcaatgccgtcggcaaagttagatgatttatcctgcagatagagcaccggagccatcggctggctgtcggaatcgtcgtcggaagacaggtcaaaggtcatgtcctgtgccgccatacgtgattccatctcacgtacgtctttgctggttacgcccagttcacgggccaccatttcgacttcatcctggttaaaccagcccagacgctgcttggttttacgcaggttgaagaacagtttgcgctgcgctttggtggtcgcaactttgacgatacgccagttacgcagaacgtattcgtggatctctgctttgatccagtgaacggcgaaggagaccaggcgcacacccacttccgggttgaaacggcgcactgctttcatcaggccgatgttaccttcctgaatcaaatccgcctgtggcaggccatagcccgcataattacgagcaatatgaacaacaaaccgcaggtgagacaggatcagcgttttagctgcttccagatcgccatggtaatgcagcttttcagccagcgcccgctcctcgtcagccgacaacatcggccacgcgttagctgcccggatgtaggaatccaggttgccaactggggctaaagctaaactttgcattttgtcagtcattcaaatcctctcaatcgatatcttctggcgcttcagtggtagcaacaactgtgccagagcttaagagcaacgaggttatcattcactgttttatcagaccgtgattttatccacaagttcaatgcaagcttgtgaataaattacgcacaaaatgtgacatagagatgaaataccgggaagagacaacggggtctctttccctgctacggaacccattgcagggaaagagtataacacgcttttattattcaggcgtaaagtggcgtaaatgttgtaccgtggcaagccacgctgccacccagccaatcatcgagcataccagcagcaatagcaggcattcatcgaatgataagccattgatatcaaacttcgttccgaaaacctgtgccacttccgcaaccgccgatgacaatcgcagcaccagaatttctgacaaaattaatgacaacaatgcgccagaaaatcccagcagtgcgccaccatacaggaacgggcgcaggatgaatccatctgtcgcaccaatcagtttctgtacgttaatggagtcacggcgagcaaagatactcagacgcacactgttaccgatgacgaggaacacggccgccaccatcaacacgccgatcatcgccgaaacgcgcccgaccagcccggtcaacgccgccagacgggcaaaccagctgtcatccatccgcacttcgtcaatgccgttaatctgcgtgatacgatcacgcagcgtattcagtgattccgtcccctggaaatcgagtttcgggatcaccaccgccactgccggaagcgggttttcttccagcatatccagcgcaccaccaaaaccagaccagttacggaactcacccagtgcgtcttcacgagaaagatagttcactttctccacgccttgctcggcctgcaactgtgccaccacgcccgcagcagcgtcatcgtccagcgttttttgcagataaacagtgatttgcggtgacggataatactgcgtcgccgcctggttaacgtttttgtacaccatataacagacgctgggcagcgtcagagaaatggcgataaccatcaccgttaaaaacgtggcgaacggtttgcttttcagatcctgcaatgcgccgtggaaggcatagcgcacctgttcgttgaaaacgttggttttgcgatttaccggttttggcgaggatttcgcgcgttttggtgcgttacgaccgccgtcgcctgagccgccgaccgatttacggaagcgatcaagacgcccgccaaactgccgaatatgattgattgcatcgcgcttattcatggcccacgcctccatgcaagtgaccatcgctcagggtgagcatgcgataggaacgccgcgagatcaggttgatgtcgtgcgttgccatcaatacggttaccccaacgcggttaaactcttcaaacagacgtaaaatgccttccgacagcgcgtcgtccaggttaccagtcggttcgtccgccagcagtaccgcgggcttgttcaccaccgcgcgggcaatgccaacacgctgttgttcaccgcccgaaagctgaatagggaagttcttcgctttgtccagtagcccgactttatccagcgccgccgacacccggcgacgaatatcgtcaccgctggcaccggcgataatcagcgggatcgccacgttatcgtagacagtacggtccatcagtagatggtgatcctggaaaatcatgccaatctggcggcgcagaaacggaacttcacggtttttcagacgcgtgatgtcatggccgctaaaccagattttcccggcgctgggccgctcaatcccacagatcagcttcaggagggtacttttccctgcgccggaatgaccggtcagaaacgccatctcacccggctgcatatggaacgtaacgccctgcagcgcctgtctcccaccgagataagccttgctgacatgttcaaagcgaatcattgttaatcctctcgggcaaaaagtgcctctataaagtcgtccgccttaaacggacgcaaatcctcaatacgttcgccgacaccaatgtagcggatagggataccaaactggtcagccaccgagaaaattaccccgcctttcgccgtgccgtccagtttcgttagcgtgatgccggttaagccaacggcttcatggaacagtttggcctggcttaccgcgttctgcccggtgctggcatcaatagtcagcataacttcatgcggcgcttcaacgtcgagtttcttcatcacgcggacgattttcttcaactcttccatcaggtgcgatttgttctgcaggcgtccggctgtatcggcaatcaggacgtcgatattacgcgctttagctgcctgaatggcgtcgaagataacagaggcggaatccgccccggtatgctgggcaatcaccggaatattgttgcgctgaccccagacctgaagctgttcaaccgcagctgcacggaaagtatcacccgccgccagcatcaccgatttaccctgctgctcaaactgacgcgccagcttaccaatcgtcgtggttttacccacaccgttgacgcccaccatcaggatcacaaacggcgctttgccttcaacattcagcggctcatcgactttcgccagaatctcgcccatctcttctttcagcaggccatagagcgcctcggcgtcacgaagctgcttgcgggatgcgccttccgtcagattggtgataattttacgtgtggtttccacacccacatcggcgatcaaaagctgctcttccagctcctcaaacagatcatcgtcgatttttttaccgcggaacaggctgataaatccggaaccgagattttctttggtttttaacaggctgcgtttcaggcgcgcgaaaaaaccttctttggtcggtttttcctgctcctgagcgatttcttccaccggctgctcttcttctgccggaggaaccaccatcaccgcctcttctgccgcttcggcagccagcgccgtttccagctcttcgtcggtaatttcttctttagccgcttcttcttccgccgcttcgacaatctctacggtttccgcttcagcctgccactcttctggcgaaaccgcttcggcgttgacgtcttccggcaacggcagctcttcacgttcgatagccactggctccggcgtttcttctacgaccggttccggctgtgcaacgacttccgcttcaggctgcgctttttcactttcagcaacctgttcagtgacttccacaacgtcggcagcaaaagtttccgcctcggcttcagtatgcgcttgcggctgctcttcaacggcttgttcagaggccttcacaggctcttgcgcctgaacgatttcttctacaaccggttgttcattctgaacttctgtctctttttccggggtctgctctttttgaccaaagcccagccaggaaaaaaagccacgttttttttctttcgccatttgcgactacactcctcgctgttgcttcatggcacagcgttaacgctatgtacatagcagctaaaaaaatgatgaaatagtctatcacttaacttaattcacatcaccgcctgcaagtatgtgttatctggcggattgagcaatttatcatgaaaaaaccgaatcattccggcagcggccaaatccgcattattggcgggcagtggcgaggccgtaaactcccggttcctgatagcccaggtctgcgccccaccaccgaccgcgtacgcgaaacgttgtttaactggctggctccggtcattgttgacgcccaatgtctggattgcttcgccgggagcggcgcgctggggctggaagcgttatcgcgctacgctgcgggggcaacgttgattgagatggatcgcgcggtttctcagcagttaattaagaatctggcgacactaaaagcaggcaatgcacgcgtggtgaacagcaacgcgatgtcattcctggcgcaaaaaggtacaccgcataatatcgtgtttgtcgatccaccgttccgccgtggcttgttagaagagacgataaatttactggaagataacggctggctggctgacgaagccctgatttatgtcgaaagcgaagtcgaaaacggtctgcccactgttccagcaaactggtcattacatcgggaaaaagtggcgggtcaggtggcttatcggctgtatcaacgcgaagcacaaggagaaagtgatgctgattaatattggtcgtttgttaatgctctgcgtttggggatttttaatcctcaacctggtgcatcccttcccacgcccgctgaatatcttcgttaacgtggcgctgatttttaccgtgctgatgcatggtatgcagctggcgctattgaaatccactttaccgaaagatggcccgcagatgaccaccgccgaaaaggtacggattttccttttcggcgtgtttgaactgctggcctggcagaagaaatttaaagttaaaaaataaccttattgttcgcctacaaagctgacaaagcgcgttcctttatagctcagcgtacctttatcgcccactgtcagggcgtggtactgctgggcgtcgaggcgaaacgtctgctccattcctccgctttgcggtttgaagcttgcctcatagcgtatactggtgcctgccggagtcacttcctgctggcgcgaacggcgatcgttaatcggtttttcccgcttgttgctcaccaccaccagcttttgctggagcggagccatatcattatcagctttttcccgtcgctgttgcataaaacgaaacgatgcggcgacgacaattaagccaatgataacaataaagaaaagaggtggtttgctcatctttatccctcatcggaaaatgcggaaataagcataccctgccagttatggtgttgtcatccgtccaccctcgccactaaactggaagcaagaccgtaggcattccgcttacgaaaaaataacgaattcaaggaactaagatgctttggtcgtttatcgctgtctgtctttccgcatggctatctgtggatgcatcgtatcgtgggccaacctggcaacgctgggtgtttaaaccgttaacccttcttctcctgctgttactggcctggcaagcgccgatgttcgacgccattagctatctggtgctggcagggctgtgcgcctcactgctgggcgatgcgctaaccctgttgccacgtcaacgtctgatgtacgccatcggcgcgtttttcctctcgcacctgctgtacaccatctatttcgccagtcagatgacgctctctttcttctggcctctaccactggtgctgctggttctgggtgcgctgttactggcgattatctggacgcgcctggaagagtaccgttggcctatctgcacgtttatcggcatgacgctggtgatggtgtggctggcaggtgaactgtggttcttccgtccgaccgctccggcgctctctgcgtttgttggcgcttcgttgctgtttatcagtaactttgtctggctggggagccactatcgccgacgcttccgtgcggataacgcgattgctgcggcctgctactttgccggtcacttcctgatcgtccgctcgctgtatctctgataaaacttgactctggagtcgactccagagtgtatccttcggttaatgagaaaaaacttaaccggaggatgccatgtcgactcctgacaatcacggcaagaaagcccctcaatttgctgcgttcaaaccgctaaccacggtacagaacgccaacgactgttgctgcgacggcgcatgttccagcacgccaactctctctgaaaacgtctccggcacccgctatagctggaaagtcagcggcatggactgcgccgcctgtgcgcgcaaggtagaaaatgccgtgcgccagcttgcaggcgtgaatcaggtgcaggtgttgttcgccaccgaaaaactggtggtcgatgccgacaatgacattcgtgcacaagttgaatctgcgctgcaaaaagcaggctattccctgcgcgatgaacaggccgccgaagaaccgcaagcatcacgcctgaaagagaatctgccgctgattacgctaatcgtgatgatggcaatcagctggggtctggagcagttcaatcatccgttcgggcaactggcgtttatcgcgaccacgctggttgggctgtacccgattgctcgtcaggcattacggttgatcaaatccggcagctacttcgccattgaaaccttaatgagcgtagccgctattggtgcactgtttattggcgcaacggctgaagctgcgatggtgttgctgctgtttttgattggtgaacgactggaaggctgggccgccagccgcgcgcgtcagggcgttagcgcgttaatggcgctgaaaccagaaaccgccacgcgcctgcgtaagggtgagcgggaagaggtggcgattaacagcctgcgccctggcgatgtgattgaagtcgccgcaggtgggcgtttgcctgccgacggtaaactgctctcaccgtttgccagttttgatgaaagcgccctgaccggcgaatccattccggtggagcgcgcaacgggcgataaagtccctgctggtgccaccagcgtagaccgtctggtgacgttggaagtgctgtcagaaccgggagccagcgccattgaccggattctgaaactgatcgaagaagccgaagagcgtcgcgctcccattgagcggtttatcgaccgtttcagccgtatctatacgcccgcgattatggccgtcgctctgctggtgacgctggtgccaccgctgctgtttgccgccagctggcaggagtggatttataaagggctgacgctgctgctgattggctgcccgtgtgcgttagttatctcaacgcctgcggcgattacctccgggctggcggcggcagcgcgtcgtggggcgttgattaaaggcggagcggcgctggaacagctgggtcgtgttactcaggtggcgtttgataaaaccggtacgctgaccgtcggtaaaccgcgcgttaccgcgattcatccggcaacgggtattagtgaatctgaactgctgacactggcggcggcggtcgagcaaggcgcgacgcatccactggcgcaagccatcgtacgcgaagcacaggttgctgaactcgccattcccaccgccgaatcacagcgggcgctggtcgggtctggcattgaagcgcaggttaacggtgagcgcgtattgatttgcgctgccgggaaacatcccgctgatgcatttactggtttaattaacgaactggaaagcgccgggcaaacggtagtgctggtagtacgtaacgatgacgtgcttggtgtcattgcgttacaggataccctgcgcgccgatgctgcaactgccatcagtgaactgaacgcgctgggcgtcaaaggggtgatcctcaccggcgataatccacgcgcagcggcggcaattgccggggagctggggctggagtttaaagcgggcctgttgccggaagataaagtcaaagcggtgaccgagctgaatcaacatgcgccgctggcgatggtcggtgacggtattaacgacgcgccagcgatgaaagctgccgccatcgggattgcaatgggtagcggcacagacgtggcgctggaaaccgccgacgcagcattaacccataaccacctgcgcggcctggtgcaaatgattgaactggcacgcgccactcacgccaatatccgccagaacatcactattgcgctggggctgaaagggatcttcctcgtcaccacgctgttagggatgaccgggttgtggctggcagtgctggcagatacgggggcgacggtgctggtgacagcgaatgcgttaagattgttgcgcaggagataaggcaaaccgatcgcaacattgagcgcgatcggtcccctcgcccctctggggagagggttagggtgaggggaaaaggcggcatcgaagccaatcagcccctatcaaccgcctttacgaatcaaataacgataaggcagtccatccgtctctttagcaaccagttcgtgttccataaaggtacaaaacccaggaatatcgcgggtagtggccggatcgtcggcgataatcagcaacgtttcgccaggctgcatattgcgcacggttttgcgcaccatcatcaccggttccgggcagcgcaggccaagcgcgtcgagtgtgtggtcagggctggaaaagagatcggtcattttcttctcatcacttaaaaaaacggcgctagtttacgccctgtgagtccgtaagcaaactaggttaacgattgcgtgaaaattaaccattgcattgtcaacgtaaagcagtatcatgcggcggctcgaaaaaagggtaagcacgttattatgttaaggtaacagacgtgtcgtacgtattgggttccctcaccccaatggttaatcaaaaaggtacaatatgaacgttttctcgcaaactcaacgctataaggcgttgttctggttatcgttatttcatctgctggtgatcacctccagtaactatctggttcagcttcccgtctccattttgggtttccataccacctggggcgcgtttagctttccgtttatttttcttgctaccgacctgaccgtgcgtatttttggcgcaccgctggcccgacgcattatcttcgcggtaatgatccctgcgttattaatctcctacgtcatctcgtcgctattctatatgggttcctggcagggattcggcgcactcgcccacttcaacctgtttgtcgcccgtatcgccaccgccagtttcatggcctacgcgctggggcaaatcctcgacgtgcacgtttttaaccgcctgcgtcagagtcgccgctggtggctggcaccgacagcgtccacactgttcggtaacgtcagcgacacgctggcctttttcttcattgccttctggcgtagcccggatgcctttatggctgaacactggatggaaatcgcgctggtcgattactgtttcaaagtgttaatcagtatcgttttcttcctgccaatgtatggcgtattactcaatatgctgttgaaaagactggcagataaatccgaaatcaacgctttgcaggcgagttaaaggttcgttatcagagttgtgataagatggatgaatgagccgttatggccgtttatcgaaaggaagaagtcaatgcgcaatctggttaaatatgtcggaattggcctgctggttatggggcttgcggcctgtgatgataaagacactaacgctacggcgcagggttcggtcgcggaaagtaacgctaccgggaatcccgtcaacctgcttgatggcaagttaagtttctcgctgccagcggatatgaccgaccagagcggtaagctgggaacgcaggccaataacatgcatgtctggtccgacgccaccgggcagaaagcagtcatcgtcatcatgggcgatgatccgaaagaagatctggcggtgctggcgaagcgtctggaagatcagcaacgtagccgcgatccgcagctgcaagtggtaaccaataaagccattgagctgaaaggtcacaaaatgcagcagttagacagtattatctccgcgaaaggccagacggcgtactcttccgttattctgggtaacgtgggtaatcaactgctgaccatgcaaattacgctgcccgctgacgatcagcaaaaagcgcagaccaccgcagaaaacatcattaatacgctggttattcagtaagttttaagatgatgaggcggcctcagggacgtgttccggaggccgtttttttaatcgccacgtcagtaataacgcgattgcgaccagtcccgccgccgccagataaatcaccggtacgcccgcccagctcatcaccagcccagccagtggtccagtcacgccaagcgataaatccataaatacggtgtaagttgccagcgccgccccctgattttgctgcggaaccgcttttaccgccactacacccaatgccgggaacaccagcgaaaacccggcccccgccagtaagacgccgattttcgccatccacggcatagtcgccacgccaaccagtagcaggccgattatctcaacgctaaagcaaatcatcgctacgtttaagccaccgatacggttaatgccgttagggaataacaaacgcgtaccgacaaacgcacagctaaacagcgtcagcgcgaaagccgcaccgtcccaacctttagcgtcataaaacagcgtgataaaggtggcgatgacgccaaatccggcggaagccagtgccagcgccataccgtacagccagacgcgcccaagcaccgcgcgaaacggcagcggtttgcctttactggcttttaccgtcggacgcgggatcgccaacaaaatggccaccagcgccacgcccataatgattaacgctaacgcctgcaagccgccccagtgataaaacacgacgcctaacggcgcacccatcgccatcgccccgtaagtgacaatgccgttccacgaaatcacccgcccgatatgcagcgagccaaccacgccaacgccccatagggtcgatcccgttccggcaaaactttgcccaatcccaaggatgacgcgccccaggcaaagtaataacaggctgatgacaggcagactggcggttaatcctgccgtcagataccccagaccgctcaaaaagcagccgcataaaccgaagacgacaatctttttgggtcccagcgaatcggcgtaacgtccggcatgagggcggctcagcaaggtggcgaaatattgcaggctgataaccaatcctgcccagaaggcgctaaagcccatcacatcatggacatagcccggtaatacagcgagcggcaacccgatggtgaggtagctggcgaagttaaacatgactatagagacaatgcgcaaattcaggcgcaatccgtttagcgcgggttcggctacgggttcgggcatgaggatcaccacatttttacaacagtgtttcatttttaccacgtgctgacgtgaaaatcagcagtaagaatcagaatattgctggcgtgactcccgctacacttaatacaaaaagtcacaaggaagccccaatggaaacccctcaacccgataaaacgggcatgcacattctgctcaagctggcctcgctggtagtgatcctcgcgggcattcacgcagcggcagatatcattgtgcagctgttactggcgctgttttttgccatcgtcctcaacccgctcgtcacctggtttattcgtcggggagtacaacgccccgttgccattacgattgtagtggtggtgatgctgatcgcactaaccgcgctggtcggcgtactggcggcatcgtttaacgaatttatctctatgctgccgaagtttaataaggagctgacgcgcaaactttttaaattgcaggagatgttgccttttcttaatttgcatatgtcgccggagcgaatgctgcagcggatggactcggaaaaagtggttaccttcaccacagcgctaatgaccgggctttccggggcaatggcgagcgtgcttttgctggtgatgaccgtagtttttatgctgtttgaagtgcgccacgtcccttacaaaatgcgttttgcgctgaataatccacagattcacatcgcgggattacaccgcgcacttaaaggcgtttcgcactatcttgcattgaagacgctactcagtttatggacaggtgtcatcgtctggctggggctggagctgatgggggtgcagtttgcgctgatgtgggcagtactggcgtttttgctcaactacgtgcccaatatcggcgcggtaatttccgccgtaccgccaatgattcaggtgctgctgtttaatggtgtttacgaatgtattctggtcggcgcattgtttttagtggtccatatggtcatcggcaatattttagaaccacggatgatgggccatcgcctggggatgtccaccatggtggtatttctttcattgttaatttggggatggctgctcggcccggtagggatgctactttcggtgccattaaccagcgtgtgtaaaatctggatggaaaccaccaaaggcggtagcaaactggcgattttactggggccgggcagaccgaaaagtcggttaccgggatgaggcgacaagtgatacgatacgcactttcattttccattaaacgttggccctgatatgtatcggatagttctggggaaagtttcgaccttaagcgcagctccactgccaccgggtttacgcgagcaagcaccgcaaggtccacgacgcgaacgctggctggcggggcgtgcattgctttcgcacacgctttccccgctaccggagatcatctatggcgaacaaggcaaacctgcatttgcgccggaaatgccgctatggttcaacttaagccatagcggtgacgatatcgccctgctgttgagtgatgaaggcgaagtcggctgcgatatcgaagtgattcgcccgcgcgccaactggcgctggctggcgaacgccgtattcagcctcggggaacacgctgagatggacgccgtgcatcctgatcagcaactggaaatgttctggcgcatctggacgcgcaaagaagccatcgttaaacagcgtggcggcagcgcctggcaaatcgtcagcgtagacagcacctatcactcctcgctgtcagtcagccattgtcagcttgaaaatttaagccttgcgatctgcacccctactccctttacgctcaccgccgacagtgtgcaatggatcgattcagttaactgatccgcccacccgactgcccatctattgatccagaacaggtaatcagtatgacgaatacttaaaatcgtcatacttatttccgccatctattttaatccattggggttaccatgctctccacactccgccgcactctatttgcgctgctggcttgtgcgtcttttatcgtccatgccgctgcaccagatgaaatcaccaccgcctggccggtgaatgtcgggccactaaacccgcacctttacacgcctaaccagatgttcgcccagagcatggtttatgaaccattggtgaaatatcaggcagacggttcggtgatcccgtggctggcaaaaagctggactcattcagaagatggtaaaacctggaccttcaccctgcgtgatgacgtgaaattctccaacggtgaaccgttcgatgccgaggcggcggcagaaaacttccgcgcagtgctcgataaccgtcaacgtcacgcctggctggagctggcaaaccagattgttgatgttaaagcactcagtaaaacagagctgcaaattaccctgaaaagcgcctactatcctttcctgcaagaactggccctgccccgtcctttccgttttatcgctccctcgcagtttaaaaaccatgaaaccatgaacggaattaaagcgccgattggcaccggaccgtggattttgcaggaatcgaaactgaatcagtacgatgtcttcgtccgtaacgaaaactactggggcgaaaagccagcgattaaaaagatcacctttaacgtcatcccggacccgactacccgcgcggtggcgtttgaaactggcgatatcgacctgctgtacggaaacgaagggttattaccgctcgataccttcgcccgctttagccagaatccggcttaccacacccaactgtcacagccgatcgaaaccgtgatgctggcgctcaataccgccaaagcccccaccaacgagctggcagtacgtgaagctcttaattacgcggtaaacaaaaaatcgctgattgataacgcgttgtatggcacccagcaggtcgccgacaccctgtttgccccttctgtgccctacgccaacctcggcctgaaaccgagccagtacgatccgcaaaaagcgaaagcgttgctggaaaaagccggttggacgctgcctgcgggcaaagacatccgcgagaaaaatggtcagccgctgcgcattgaactttcgttcatcggcaccgatgcgttaagcaaatcgatggcggaaatcattcaggctgatatgcgccagattggcgcagatgtctcgctgattggcgaagaagagagcagtatctatgctcgtcagcgcgacggtcgttttggcatgattttccaccgcacctggggcgcgccatatgatccacacgccttcctcagttcaatgcgcgtaccgtcacacgctgacttccaggcacagcaaggattagccgacaaaccgctgattgataaagagatcggcgaagtgctggcgacccatgacgaaacgcaacgtcaggcgctgtatcgcgacattctgacccgtctgcatgacgaggcggtttatctgcctatcagttacatctcaatgatggtggtatcaaaaccggagctgggtaacatcccctacgcgccgatcgccaccgaaattccgttcgaacagattaaaccggtgaaaccttaatgttgcgttacgtattacgccgctttctgctgctgatcccgatggtgctcgccgcctcggtgatcatttttctgatgctgcgcctcggtaccggcgacccggcgctcgattatttgcgtctgtctaacctgccgccgacgccggagatgctggcctctacccgcaccatgctgggactggatcagccgctgtacgtccagtacggcacctggttgtggaaggcgctgcatcttgactttggtatctcattcgccagccaacgcccggtactggacgatatgctgaacttcctgcccgccacgctggaacttgcaggtgcggcgctggtattaattctgctcacttccgtaccgctcggtatctgggcggcgcgccatcgcgaccgtctgccggatttcgccgtacgtttcatcgcgtttcttggcgtgtcgatgcctaacttctggctggcgtttttactggtgatggcgttttcggtgtatctgcaatggctacccgcgatgggttacggcggctggcagcacatcattttgcctgcggtttccattgcctttatgtcgctggcgattaacgcgcgtttactgcgcgccagtatgctggacgtcgccggtcagcgtcacgtcacctgggcgcgtctgcgcggcctgaacgacaaacagaccgaacgtcgccacatcctgcgcaatgcctcgctgccgatgatcaccgccgtggggatgcatatcggcgaactgattggcgggacgatgattatcgaaaacatctttgcctggccgggcgtcgggcgctatgcggtgtcggcgatttttaaccgtgactatccggtgatccagtgctttacgctgatgatggtggtggtttttgtggtctgtaatttgattgtcgatttgctcaacgccgcgctggacccgcgcattcgtcgtcatgaaggagcgcacgcgtgaactttttcctctcttcccgctggtcggtacgcctggcgctgatcattatcgccctgctggcgctgattgcgctcaccagccagtggtggctgccgtatgacccacaggcgattgatttgccgtcgcgcctgctttcgccggatgcgcagcactggctgggcaccgatcacttaggtcgcgatattttctcgcggctgatggcagcgacccgcgtgtcgctcggttcggtaatggcctgcctgctgctggtgctgacattagggctggttattggcggcagcgccgggttgattggcgggcgcgttgatcaggccaccatgcgcgtcgccgatatgtttatgaccttcccgacctcgattctgtcgttctttatggttggcgtgctcggcaccgggctgaccaacgtaattatcgccatcgccctgtcgcactgggcgtggtatgcacgcatggtgcgcagcctggtgatttcactacgccaacgcgagtttgtgctggcgtcacggctttccggtgcgggccatgtgcgggtgtttgtcgatcatctggcaggcgcggtgatcccttcgctgctggtgctggcaacgctggatatcggccatatgatgctgcacgtcgcggggatgtctttccttggcctcggtgtgaccgcgccgaccgccgaatggggcgtgatgattaacgacgcgcgccagtatatctggacccagccgctgcaaatgttctggccggggctggcgctgtttatcagcgtgatggcctttaacctggtgggtgacgcactgcgcgatcatctggaccctcatctggtgacggagcacgcacactaatgccgcaacagattgaactacgtaatatcgcgctacaggccgcgcagccgctggtacacggtgtatcgttaaccctgcaacgcgggcgcgtgctggcgttagtcggcggtagcggcagcgggaaatcattaacctgcgccgcaacgctgggcattttgcccgctggcgttcgccagacggcgggggaaattttagccgatggcaaaccggtttcgccttgcgccctgcgcggcatcaaaattgccaccatcatgcagaacccgcgcagcgcctttaatccactgcacaccatgcacacccacgcgcgggaaacctgcctggcgttagggaaacccgccgatgacgctacgcttaccgctgccatagaagcggtggggctggaaaacgccgcgcgcgtgctgaagctgtacccgttcgagatgagcggcggcatgttgcagcgcatgatgattgcgatggcggtgctgtgtgaatcaccgtttatcatcgccgatgaaccgaccaccgaccttgacgtggtagcacaggcgcgcatcctcgatctgctggaaagcattatgcaaaaacaagcgccgggaatgctgctggtgacccatgatatgggcgttgtggcgcgtctggcggatgacgtggcggtgatgtctgacggtaagattgtcgaacagggcgatgtagaaacgctgtttaacgcccccaaacatacagtgacgcgcagcctggtttccgctcatctcgccctctacggtatggagctggcatcatgactttacttaacatctccggcctttcccatcactatgcgcacggtggatttaacggaaaacatcaacatcaggcggtgctgaataacgtttccctgaccctgaaaagcggcgaaaccgtcgccctgctggggcgcagcggctgcgggaaaagtaccctcgcgcggttgctggtgggtttagaatcgcccgcgcaggggaatattagctggcgtggcgaaccgctggcgaaactcaatcgcgcccagcgtaaagcgttccgccgcgatattcagatggtatttcaggactccatcagcgccgtgaatccgcgcaaaaccgtgcgcgagatcctgcgtgaaccgatgcgccacctgctatcactgaaaaaatccgaacaactggcgcgcgccagcgaaatgctgaaggcggtcgatctcgatgacagcgttctcgacaaacgcccaccgcagttaagcggcggccagctccagcgcgtctgcctggctcgcgcgctggcggtcgaaccgaaactactgattctggatgaagccgtttctaaccttgatctcgtgttacaggcgggtgtcattcgcctgctgaaaaagctacaacaacagtttggcaccgcctgcctgttcatcacccacgacttacgcctggtagaacgcttttgccagcgggtaatggttatggacaacggacaaatcgtcgaaacccaggtggtgggagagaaattaaccttttcctctgacgccggacgtgtgctacaaaacgcggtattacccgcattccccgtgcgccgtcgcaccacagaaaaggtttaacgcaaatgcaacgagtcaccatcacgcttgatgacgatttactggagacgctggacagcctgagccagcgtcgtggttataacaaccgttccgaagctatccgcgacattctgcgtagcgccctggcgcaagaggccacccagcagcacggcacgcaaggtttcgcggtgctgtcgtatgtgtatgaacacgaaaaacgcgacttagccagccgcattgtctccacccagcatcatcaccacgacctctccgtcgccacgctgcatgtgcacatcaaccacgacgactgtctggaaatcgccgtgttgaaaggtgacatgggtgacgtgcagcattttgccgatgacgttatcgcccagcgcggcgtgcggcacgggcatttgcagtgcttgccgaaggaagattgagtctattattgggtcctttggtgaacgatcaacaaagggccactagcacacctgattcctctctaaataccctatccgaaccttctcttttgtaacgttctaaatatattcctaaaaatcttcaattcattgtgaccacaagtttttcttcgctttttcgtatgaagatactgtcattaaaataatagaaaaggattttacgatgagcggaaaaccggcggcgcgtcagggtgacatgacgcagtatggcggtagcattgttcagggttcagccggggtacgtattggtgcccccaccggcgtggcctgttcggtgtgccccggcggagtgacgtccggccatccggtcaatcccctgctcggtgcaaaggtccttcccggtgaaaccgacatcgccctgcccggcccgctgccgttcatcctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggttggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgcctggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccacgcggcgaactggcggtggtgtatgaccgtagtggcaaacaggtgcgcagctttacttacgatgataaataccggggccggatggtggcgcaccgtcacacgggccggccggaaatccgttaccgttacgacagcgacgggcgggtgacagaacagctaaacccggcaggcttaagctacacgtatcagtatgagaaagaccgcatcaccatcaccgacagcctggaccgccgtgaagtgctgcacacgcagggcgaagccgggctgaagcgggtggtgaaaaaggaacacgcggacggcagcgtcacgcagagtcagtttgacgccgtgggcaggctcagggcacagacggatgccgcaggcaggacaacagagtacagcccggatgtggtgacgggcctcatcacgcgcataaccacgccggatggcagggcatcggcgttttactataaccaccacaaccagttaacgtcagccaccgggcctgacgggctggaattgcgccgggaatatgatgaattgggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcaccgactgttccggttatgtaacccgttatgaccatgaccgcttcgggcagatgacggcggtgcaccgcgaggaagggctgagtcagtaccgcgcatacgacagccgtggacagttaattgccgtgaaagacacgcagggccatgaaacgcggtatgaatacaacatcgccggtgacctgaccgccgtcattgccccggacggcagcagaaacgggacacagtacgatgcgtggggaaaggccgtccgtaccacgcagggcgggctgacgcgcagtatggaatacgatgctgccggacgggtcatccgcctgaccagtgaaaacggcagccacaccaccttccgttacgatgtacttgaccggctgatacaggaaaccggctttgacggccgcacacagcgttatcaccacgacctgaccggcaaacttatccgcagcgaggatgagggtctggtcacccactggcactatgacgaagcagaccgcctcacgcaccgcaccgtgaagggtgaaaccgcagagcggtggcagtatgacgaacgtggctggctgacagacatcagccatatcagcgaagggcaccgggtggcggtgcattacaggtatgatgagaaaggccggctgaccggtgagcgtcagacggtgcatcacccgcagacggaagcactgctctggcagcatgagaccagacatgcgtacaacgcgcaggggctggcgaaccgctgtataccggacagcctgcccgccgtggaatggctgacctacggcagcggttacctggcaggcatgaaactcggcgacacaccgctggtggagtacacccgcgaccgcctgcaccgggaaacgctgcgcagcttcggccgttatgaactcaccaccgcttatacccctgccgggcagttacagagccagcacctgaacagcctgctgtctgaccgcgattacacctggaacgacaacggcgaactcatccgcatcagcagcccgcgccagacccggagttacagctacagcaccaccggcaggctgaccggcgttcacaccaccgcagcgaatctggatatccgcatcccgtatgccacagacccggcaggtaaccgcctgcccgacccggagctgcacccggacagcaccctcagcatgtggccggataaccgtatcgcccgtgacgcgcactatctttaccggtatgaccgtcacggcaggctgacagagaaaaccgacctcatcccggaaggggttatccgcacggatgatgagcggactcaccggtaccattacgacagtcagcaccggctggtgcactacacgcggacacaatatgaagagccgctggtcgaaagtcgctatctttacgacccgctgggccgcagggtggcaaaacgggtgtggcggcgtgaacgggacctgacgggctggatgtcgctgtcacggaaaccgcaagtgacctggtacggctgggacggcgaccggctgaccacgatacagaacgacaggagccgcatccagacgatttatcagccggggagcttcacgccactcatcagggtcgaaactgccaccggtgagctggcgaaaacgcagcgccgcagcctggcggatgcccttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgaccgtggagcagatgcaaaaccagatggacccggtgtacacgccggcgcgaaaaatccacctgtaccactgcgaccatcgcggcctgccgctggcgctcatcagcacggaaggggcaacagcgtggtgcgcagaatatgatgaatggggcaacctgctgaatgaagagaacccgcatcagctgcagcagcttatccggctgccggggcagcagtatgatgaggagtccggcctgtattacaaccgccaccgctattatgacccgctgcaggggcgatatatcactcaggatccgattggactgaaggggggatggaacctgtatggatatcaattgaatccgatatcagacatcgaccccctgggtttatctatgtgggaggatgcaaaatcgggggcatgtactaatggtctttgcggcacactatccgctatgataggtccagataaatttgattctatagatagcaccgcatatgacgccttaaataaaataaatagccaatctatttgcgaagataaagagttcgctggtttaatatgtaaggataatagtggcagatatttctcaacagcacctaaccgaggagaaagaaaaggatcatatccattcaatagcccttgccctaatggtactgagaaagtatcagcttatcatactcatggtgcagatagtcatggagaatattgggacgaaatattttcaggtaaagatgagaaaatagttaaaagtaaagataacaatatcaagtcattttatttaggtacgcccagtggtaattttaaagcaatagataaccacgggaaggaaataacaaacagaaaaggattacctaatgtctgcagagttcatggtaatatgtaaaaaaatattgtttaggaactgtgtcattgtatctttgtttgtttttacatacaacacatgggcgcagtgtaataataatattaaaataatgcgcaagtatgaaagtgaaggtaaatataccgttagaaatttggttaaaaataaagctatagcattggaattagctgagatatatgttaagaatcgttatggacaggatgccgcagaagaagaaaaaccatacgaaatcactgagttaacaacaagttgggttgttgaaggtaccattcactcagaccaaattgctggtggggtttttattatagaaataggcaaaaatgatgggagaattctgaattttggccacggaaaataagtatgtaaggataatcaaacatcgtgtgcgctgatggcagagtaggtggaggactccagacagtcaaacgatagaaaaagatagcctttatggaggttcctgcaatgtcaaatacataccagaaaagaaaggcaagtaaagagtatggtttatataataaatgtaagaaactaaatgatgatgaattatttcgcttacttgatgatcgcaattccttgaaaaggatttcatctgccagagtattacagttaagaggggggcaagacgctgttagattggcaattgaattctgcactgacaaaaattatatccgtagagatatcggagcatttatactcgggcaaatataaatttgcaaaaaatgcgaagataatgtttttaatattttgaacaatatggcattgaatgataagagtgcttgcgttcgagctacggcaatcgagtcaacggccagggaaagatcatcaaaagttcactttttgcactaaataattcgcattttatgtttaaaaattgagatattccttattacctgaagctgttttttattgcttatacatgatcaaatactccttacctaattaaggagaacaaaatggaacttaaaaaattgatggaacatatttctattatccccgattacagacaaacctggaaagtggaacataaattatcggatattctactgttgactatttgtgccgttatttctggtgcagaaggttgggaagatatagaggattttggggaaacacatctcgattttttgaagcaatatggtgattttgaaaatggtattcctgttcacgataccattgccagagttgtatcctgtatcagtcctgcaaaatttcacgagtgctttattaactggatgcgtgactgccattcttcagatgataaagacgtcattgcaattgatggaaaaacgctccggcactcttatgacaagagtcgccgcaggggagcgattcatgtcattagtgcgttctcaacaatgcacagtctggtcatcggacagatcaagacggatgagaaatctaatgagattacagctatcccagaacttcttaacatgctggatattaaaggaaaaatcatcacaactgatgcgatgggttgccagaaagatattgcagagaagatacaaaaacagggaggtgattatttattcgcggtaaaaggaacccaggggcggctaaataaagcctttgaggaaaaatttccgctgaaagaattaaataatccagagcatgacagttacgcaatcagtgaaaagagtcacggcagagaagaaatccgtcttcatattgtttgcgatgtccctgatgaacttattgatttcacgtttgaatggaaagggctgaagaaattatgcgtggcagtctcctttcggtccataatagcagaacaaaagaaagagccagaaatgacggtcagatattatatcagttctgctgatttaaccgctgagaaattcgccacagcgatccgaaatcactggcacgtggagaataagctgcactggcgtctggacgtggtaatgaatgaagacgactgcaaaataagaagaggaaatgcagcagaattattttcagggatacggcacattgctattaatattttgacgaatgataaggtattcaaggcagggttaagacgtaagatgcgaaaagcagccatggacagaaactatctggcgtcagtccttgcggggagcgggctttcgtaatcttgccctgaatacaggactgagtatcaaaaagccggttaactgaaactgtccaggttttgggggtcagttcataaacgccttatccggcctaaaaacaactaaaattcaataaattgcaccgatgcgtagtccctataagcttacgcatcgggcaattgtatttacgccattgtcccaatcgtcttcctgaatcgcagcagcgcaatggtgaaaaatgcgccgccaattgccatcagcgtcagaaactgcggccagacgatttcgaatccggcaccccggtagaggatggcctgcgcgaggctaacaaagtgtgtcgtcggcatggtcagcataatgtcctgcaccatctgcggcatactttcgcgcggcgtggaaccaccggaaagcatttgcagcggcagcagcaccagaatcaccagcagccccagttgcggcattgaacgcgctatcgtccccataaaaatgccgattgacgtggtggcaaacagactgagcgccacgcccagcataaacagcgggatcgagccttcaatcggtacgcccagtacacctttcaccatcagcaccagcgataatcccgataccaccagcaccaccagccccatcgaccagatcttcgccatcatgatctcaaacggcgttatcggcatcaccagtaagtgttccaccgtgccgtgttcacgctcgcggatcagcgccgatccggtcaatacaatcgccagcatggtaatgttgttgatgatcgccatcaccccgccaaaccacgcgggatcgaggttcgggttaaagcgcatccgggtttccagcgataccaacggttcgctgttatcacggtagcgcgcgacaaagctgttcacttcaccgttgataatattctggatatacccattgccggtaaatgcctggctcatgcgcgtggcatcgacgttcacctgaatatccggctggcgtccggcgaggacatcacgctgaaaattaggcggaatatttatcgcgaaggtatagcgtccggcgtccagtccggcatccatctcatcggcggtgatcatctccggtggcaaaaaccacggacgatagaagctgttaacgatccggttcgataactgcgattgatccatatcggcaatggcgatcggcgcgaggttcaacgatcctggcgtaacggtcgctgacgaatacaccgacaccgtaaacgagaagacaatcagcgtcagcatcgctttatcaccgagcagactgcgcaactctttgatacccagattaaaaatattgcgtaaatggcgcatcatccctcctgttttttcagcagcaggatacttaagcccatcaccagcgggatggctatcagtaacgggataaaaagttgccacaaatcagtcagatccagcgctttcgagaacgtcccgcgggcgatagtcagaaaatgactggtcgggtaaacctcgccgatccaacgtccaggcccttccagcgaagctaccggatcgatcatcccggaaaactgtgtcgccgggatcaacgtgataatcgccgttccgaaaatggcggcaatctggcttttcataaaggtggagatcagcagccccattccggtggcaatgatgatatacagcagcgccgccagggtgagcgtcaggaaactgcctttatgcggtacgccaaacacaaacaccgacaggccgcagagcaggaaaaagttcagcatccccagcgcgatgtatggcaactgtttaccaagcaaaaattcactacgcgtggtgggggtcacgtaaaggttgataatcgacccaagctctttttcccgcaccacgctaagggcgcttagcattgacgggatcatcatcagcagaagcgggatcaccgccggaacaatcgctggcaggctttttacgtccgggttatagcgatagcgcgtctcaatattcatcagcccgctttggctggcgggtgtcgattgtcggctcgccacatcctgtaaccagctctggtgcatggcctgcacgtaaccttttaccgtttcagcacggctcggcatcgctccgtcgatccagacgccgagttccacaggcgtaccacgcgcgatatcgcgcccgaaattgggcgggatctcaatcgccaccgtgatatcgcccgcacgcatccgacgatcaagctcgtcataactggtgagcggcggctgttcgataaagtaacgggaaccggagaggttgagtgtccacgcctggctactgacggtctggtcgcggtcgagcaccgcaaagcgcaggttttccacatccatactgatgccgtaacccattatcagcatcaggatcaccgttcccatcagcgccagcgtcgaacgtactggatcgcgtcgcagttccagcgcttcgcggcggctgtagctaaacagacggcgcaggctaaatccctgacgcggcgcgtgggtggtgtcgtgtaccacgggcggcgcttcggcttcgttgctctgccctgccgcttcctgcaaataggcgataaatgcctcttccagactggcggctccgcgtttctcaaccagttcctgcggtgtaccgctggcaagcacttttccggcgtgcatcagtgagatgcggtcgcaacgttccgcttcgttcataaagtgggtggagatgaagatagtcactttgtcctggcgcgagagatcgaccatcaactgccagaacatatccctcgccaccggatcgacaccagaagtaggctcatcgaggattaacatctccgggcgatgaatcaccgccaccgccagcgaaagccgctggcgaatgccgagcggcaatgactccggcagaatatcttcaacgtcgttgagcttaaaacgctcgctcatttcagccactcttgcgggaatttccgcttccgggatgtgaaacaaacgggcatgtaactcaaggttttgccgcacggtgagttcgttatagagcgaaaacgcctgcgacatatagcccacccgacggcgggtatcgatatcttttggatcaaccggttgcccgaacagccacgcctcaccttcgctggcgggcagcagtccggtgagcattttcatggtggtggatttaccgcagccgttcgaaccaagaaaaccaaaaatctccccgcgtggaatgcggaaattaacgtgatcaacggcaacgaaggaaccaaaacgcatggtcagatcgcgcgcttcgatggcaatctctgcgttttcaggttgatacggtgggatcactaccgcctgatgcgcctggcgttgcgcttgcggtaacagatttataaatgcttcttccagcgtagcgctttgcgtttgctgccgtagctcttcggcgctgccagttgccagcacttctccggcattcatcgctaccagccagtcgaagcgttcggcctcttccatataggcggtggcgaccagcacgctcatattgctctgccgctggcgaatactgtcgatcagatcccagaactgggagcgggagagcgggtcaacccccgttgttggctcatcaaggatcaacagttccgggtcgtggattaacgcgcagcacagcccaagtttttgcttcatcccgccggagagtttccctgccggacgatcgcgaaacggtgctaacccggtgctggtcagcagctcattgattcgcacttcccgctccgctttgtcgtgaccgaacaggcgagcgaaaaaatcgacgttttcatacaccgacaaggtgtggtagaggtttttgcccagcccctgcggcatccaggcgatgcgcgggcagacgtcgcggcgatgcttcgggtcgcgcatatcgccgcccagcaccatcacattgccctgttcaatgacgcgggcaccggaaatcaacgacaacaagctcgacttcccgacgccgtccgggccaatcagcccgaccatacagcgggccggaatatcgagagtgatattgttcagcgcaacggtttttccataatgctggctcacgcccgccagttgcgcgacaggcgggacgggaaccagttccagatgcgtcattgcggcaacctcaccacgaggtcgtcaggccacggaagttcttcattcacccgcacccacgctacgcccggcaaaccggttttgacatattccagatgctgctggagtaattccggtgggatacgcgctttgacgcggaacatcagtttcagccgttcatcgctggtttcgacggtttttggcgtgaactgggcgacactggcgacaaaactgatggttgcaggaatacgcagatctggcgcggcatcgaggatcagccgggcttcaccgcccagtttcagcgtgcccgcctgttcggttggcaggaagaaagtcatatagacgtcgctgagatcgaccatattcagcacccgaccgcctgccgccagcacttcgcctggctcggcaacccgatactgcacgcgtccgtcacgcggggctttcagttcgctgtcatcgatatctgcggcaatgcgccgttcagtggcttgtgccgcttcgacgcgggtttgcgcctgaatgatattggtgcgtgccgcttctatagccgctttagaagccgatacctgagctttcgccgattccagcgcagctcgggcgctctcagcggcggcgcgatcgtcatccagctgttgcgcagaaatagcccctcgttgggccagtgaacgggaacgcgtatgacgttttgctacggagtccagttctgcctggcgttgattaaccagcgactgtgcggcacgagtttcgctttgtcgttgctccagcaaagcctgcgcggcagcaacggcgctttgtgcctctttgatttgcgcgatggcttccagtcgctgttcctgcaacacgcgagtatccatcttcgccagcacttcaccttcgcgaacaaacttgccttctttcaccagaatggtgtcgatacgcccggcaattttgctggcaatatccacttccgtcgcttcaatgcgcccattactgacagcaaagccttccggcacacctgccgggcgcaacagccaccacgccacgatagccgccaccgccagtaacccgacaacccaccacgccagatggcgcttactcttatccataatcgacccgccataatccctgtaagcaaacgacgcgtgttacaactgccgccgaacgacgttcagcggattcttccatccgggataagaaggaaacggcaaatacgaccagcgcgcagagcattgagcgccaacggggaaggcttagtgaaaacgggtagtaatgttgtcatcatcagcattcctggccgtaaatgaaacacgcatactcataagtgtgatctataaaactggctgacaaaacggtatccatcctgttggatagcgtttcacgcctgttcagttgcaggaacagagcattcctttttacgttttatcaacagtctcaaccagatagtaacattaatattcatgttgtctatggttcagagctgtaacattgtgcgccttctaatcaaaggcataagtccatttctgtttttttcatgctggtaagacttccagggagtggttatctcaggccctgcaccagggttaatttggcaattatgcatgctgaacattcttccagcatgtttactgtcacgggcgttaagacctaaaactgtccccgtttcgcctatgcgttctcttccaccatttccgttatgtgcaacaacttgatttatacctaacatttgtgaacatgctaatagtgcttcaagtttaggtctgtaatctgtcgaaacagaaaaataacgattaaaggatcgacaagagatagcccggctagttttaaactttttgccattaattatagcatgatgctttttattgataattgccgctaattcgaccggatcgagagcattggtcatttcatcaatagagactgttatcggtcctataatgtaacgttttcgctgatcatcaaaagttatcccatgatgatttgccattattttgtatttggggtcatagaaacatacaggataatcttttatcccagagtaggtatcctcatcgagtggtttcatacgcgtgaagttctgcatatagttaccattgcaattcgtttcatgatttccagctaatacatgaacattttcattgatactcattatgcgttttaacaaatcgatgataaattgatcaccacagatattgctaaatcgatcgccggtttggtcgcccagaaacgtacatggcgtcacagcgtctttattaataactaaataaggctgaagactttctaaaataatgtctcttctgttcaggatactgattattgtattaacattagtgttaagttgctcattaaagttctcccttagcaatacgttgagaacttcatcttctatattaagcaactggctaaggaaattttctccttcagccatgattcccaaatgtcccgttgcgaaaagcgcgaacaaaactgcaccgactgagccatcggtatcaccaaaataggttggtctggtacttgtgggatcaacgggtaaacaattggagaaatagattctgtcagcgaactggggttttatcattgtttcgaatttaatatcagatacattatattgcgatattttccagttccagatgggtttgtacgactcagtaactgcaacatcattagcattatcatttactgtcatattattaagtaaataaacaatactgcaccaattaatatcggtattatcaagagagcaaccgtaatttttgctattaattgtcacaataaactgataattattattcctacgtagaatatgagcacgcatgcccgatagcatactatatttttctgaatgatccgtttgtatggtaaatgaaattttgtcatcttgaatagattgttggaaccgttctatttgccaatcatctattttttccacaacctcaccgagcattgtcctggcaatacttgatatatcatcacctataccatttgcaatatacccaaacagttctttagtgaagttggtaacatgctcttgcaccatatcatttgttgcgattgtcgttgtactgtcgttagtgcctgccacagttccaattttcatattttacctcatattatttaccgcgaggaatacatagttaacattttatcttatgacatacacctcatgttcgatgggaaaataattatattttgcacaaatcattcagcctcaaagcataatatgaaatttcttatctcatagcagagaaagtccctaaagattgtagaggcgtcatcagaacatgcctctacaatcgattaagaaaacctatgaaatactggcaggattaaaaagacataccaccgtattcatggagttttaatgtagttgaaaacaactaagccctgaggaataaattattttattatttttatcacgtgcttccttcagggaatttagccccataataccattatcaaattgttgattatgatctaccccgggcccatgatgcccatatttttgtctaatgtatttgctggggtcttcacctttgagtgtctccccacatatgaagatacgttcacgtgctggtctgaaatcagtagtgttatcaaaataattagcatatacaggtgtgggtttcaaagtattgcttcggattagatggaatagaggatcatccatgtgttctttatgttttttattaaaaatattggctaattcctcaggatcagtaggatttttcatctgattaaatggaacctgcaaagcaccgagacaataacatttttttcttcatctcttattattccgtgatgactggttaaaacttgcctttctgagtcataattacaaacatcgagcgttttaattaagttatacgtatcaccggcagagagtttatgatttgctagtcgtgcagtatagttaccattaaaattgatttcatgatttccagccagaacgacgacatttttattaatacggctatctttattaccctccatatttcgcatagaatttagcaaagtaaggatatatttatcaccaaaaatagtactaaatctatcgcctgtatgatccccaaggaagatacaaggggttatcgcatcgtcctttaaaaaaacatgttgatgcaactcattcaagatcatgtctctcgtatttaataaatcgtagagcactttattatttttatgtttgtatgcagatgaagccatctcttcgtgttttaataattcacataataaactccaacccttttccctgatgcctatatgccctgaaacgagcaatgcataaagtacagcgcctactcttccatctgtatcgccaaaataagccgtgttggcattttgtgggttaatcacaccacactgtttatagaagtctatttttgaaaacacagatttaacatagctatcaaacttttccttagtaaacgtctctttagagacatcccaacgccagtcaggtttgaaattaccactaagaagagtaaagaaatttctcgctatgatagaaagcccatcaactttataaattatatctgatttatctccagaggaattaataaaataataaccgcccttacactcaacagtaacggtaatgggagacgataattttaacacatggttattgtctggtataattgtaaagataaacgtatcagtagtattgtcggcgaatctattatattcttgaatatctatagaaggttcactattataaaaccatactttctccatctggtgactacgatcatttaccttccagtgaccatgttgcaggaaatagatgatatgcaggccaaaatcgttatctatttgcgaatcattatccagtttatcaaattcaactatctttgcacgatgtgttttatcaaccttgccatggtgttgatgactgttaactttatctgaatgcttatcttgatggcttgaagagatgtttctaatctgattgtcaattgctttcataaataacctgtgatatttttgaattgtttgtaacaaaataaatgatacttgtctgaaaaacagatttacgacgatataaaataataatacttatatgttcgctgattttaagcaccgagactatccggtcttttaccaaataatgaagaataatccctccctggaagataattgtaaaaaacaacagcataagaattaatcttaggataaatttttatttatcatggccttttgaacgctgaaaagtagcgctctgcaaagtaaaccccgctatagttatgctatgcatttgtctttaatgatatctcgtcattatattaacaggatgaaattatcattaatgcatatttcaatattagcagggatacctgaggagtttaaagtgaacatatatatcgggtggcttttcaaattaatccctttgattatgggcttaatttgtatcgcgttaggtggctttgtgctggaaagttcagggcaaagcgagtatttcgtcgcgggtcatgtgctgatttctctggcggccatatgcctggcattattcactaccgcatttattatcatttcgcagctcacgcgcggcgttaatacgttttacaatacattgttccccattattggctatgcggggtcaattatcaccatgatatggggttgggcactgttagcaggcaatgatgtgatggcagacgagtttgtcgccggccatgttattttcggcgttggtatgattgccgcctgtgtatcgacggtggcagcgtcatccggtcactttctgctcattcccaaaaatgcagcggggagcaagagcgacggaacaccggtacaggcttattcttcattaatcggtaactgcctcattgccgttcccgttttactcaccctgctcggtttcatttggtctattacgctgttacgtagtgctgacataactccgcattatgtcgcgggtcacgtattgcttgggttaaccgcaatctgtgcctgtctaattggccttgttgccacaattgtccatcaaacacgtaatacgttttcaactaaagaacactggctgtggtgttattgggttatttttctcggctcaatcacggtactgcaggggatatacgtcttagtcagttccgatgcaagcgcccgactggctcccggcattattcttatttgcctcggaatgatctgttacagcatattctcaaaagtctggctactggcactggtatggagacgtacctgttcgttagccaacagaataccgatgattcccgtcttcacctgcctgttttgccttttcctggcatcgtttcttgcggaaatggcgcagaccgacatgggatattttattccttcgcgagttctggtcggtttgggagcggtatgctttacgttgttctcaatcgtttcaatattagaagcgggttctgctaaaaaataattgcaacgtaccggataaaaccagcgttgaccatttgcgtaacgctggtttttcttaggcatcatgaaataacgcagcattaatgcatagtggttaagtataaaaaacagcaaagttactgtttttttcaacctgttcatatttcataaagatctggccactgagtgagttttcaatcacctttccatccaccttatattaagcatggagggtttcagttcacgggctcattagaaaataatcacaagataaccactatcaaaattagctcatttttaatgcgactctaataattttcatctttaggaaataggtcaggacgactttgctgcaatcaaatcctgcgcacaagcccacgcactcgaccacgcccactggaagttatagccccccagccagccggtgacgtccatcacttcgccgatgaagtacagcccaggcactttgcgcgcttccatcgtccgtgaagagagttcgttggtgtccacgccgccgagcgtcacttcggcagtgcgatagccttcagtgccgttgggttgtacgcgccagtcggtcaatgtgctaatcagtgcctgttggtcacgcacgttgagctgttttagcgaaacatccgggatttgcccgagttgctgtaagcgttcaaccaaccgcttcggtagatgaaccgccagtgtgtttttcaggctttgattcggatgtgcgttacgctgctcattcaggaaggtttcgaggtccacatccggtagcagattgatgctgacaaattcccccggttgccagtagcttgaaatctgcaacaccgccggtccagacaagccgcggtgggtgaagagtaagttctcacggaaaacggtgccgttttcagcggtaatcacggaaggcaccgccacgcccgccagcacctgtaactcttcgagcaacggtttatgcagagtgaatggcaccagacccgcgcgggtcggcagcacgttgaggccaaattgttcggcaatcttataaccaaacggcgacgcgcccagccccggcattgacagcccaccagtcgcgatgaccagcttttcgcaaccgacagtcatgccgttcagatcaagcgtgaagcctgtttcatccttcgccacactcagcacttcgctacgcaatctgaaggtcacattgcccttctcgcactcatccaccagcatgtcgacaatctgctgcgcggagtcatcgcagaagagttgccctaacgttttctcgtgccaggcgatgccgtgtttattgaccagatcaatgaaatcccactgggtaaaacgtgcgagtgcagacttacaaaaatgcggattctggctcagataagcgcctggttcgacataaaggttggtaaagttgcagcgcccaccgccagacataaggattttgcgccctggttttttaccattatcgatcagcagaacccggcgtcctgcctgacctgccagcgcagaacagaacatacccgccgcaccagcgcctataataatggcatcaaacctttccacgttgcgctcctcttagaaaaaacgggcgtgaattgtaaagattcctcagtggtcgcaccagcatcaatattactaaaaggaagtatttgcctgaattatataagataattattttttgagtgaaatccatacagggggcaaatcaaaaaaagtctatatttcactttgcccgcgccgcgaaagtcactgataatgcgccgcgttcatgtcctcaaaatggcgtaacgtcctatgctacatttgtttgctggcctggatttgcataccgggctgttattattgcttgcactggcttttgtgctgttctacgaagccatcaatggtttccatgacacagccaacgccgtggcaaccgttatctatacccgcgcgatgcgttctcagctcgccgtggttatggcggcggtattcaactttttgggtgttttgctgggtggtctgagtgttgcctatgccattgtgcatatgctgccgacggatctgctgcttaatatgggatcgtctcatggccttgccatggtgttctctatgttgctggcggcgattatctggaacctgggtacctggtactttggtttacctgcatccagctctcatacgctgattggcgcgatcatcgggattggtttaaccaatgcgttgatgaccgggacgtcagtggtggatgcactcaatatcccgaaagtattaagtattttcggttctctgatcgtttcccctattgtcggcctggtgtttgctggcggtctgattttcttgctgcgtcgctactggagcggcaccaagaaacgcgcccgtatccacctgaccccagcggagcgtgaaaagaaagacggcaagaaaaagccgccgttctggacgcgtattgcgctgatcctttccgctatcggcgtggcgttttcgcacggcgcgaacgatggtcagaaaggcattggtctggttatgttggtattgattggcgtcgcgccagcaggcttcgtggtgaacatgaatgccactggctacgaaatcacccgtacccgtgatgccatcaacaacgtcgaagcttactttgagcagcatcctgcgctgctcaaacaggctaccggtgctgatcagttagtaccggctccggaagctggcgcaacgcaacctgcggagttccactgccatccgtcgaataccattaacgcgctcaaccgcctgaaaggtatgttgaccaccgatgtggaaagctacgacaagctgtcgcttgatcaacgtagccagatgcgccgcattatgctgtgcgtttctgacactatcgacaaagtggtgaagatgcctggcgtgagtgctgacgatcagcgcctgttgaagaaactgaagtccgacatgcttagcaccatcgagtatgcaccggtgtggatcatcatggcggtcgcgctggcgttaggtatcggtacgatgattggctggcgccgtgtggcaacgactatcggtgagaaaatcggtaagaaaggcatgacctacgctcaggggatgtctgcccagatgacggcggcagtgtctatcggcctggcgagttataccgggatgccggtttccactactcacgtactctcctcttctgtcgcggggacgatggtggtagatggtggcggcttacagcgtaaaaccgtgaccagcattctgatggcctgggtgtttacccttccggctgcggtactgctttccggcgggctgtactggctctccttgcagttcctgtaatcgtacgcaccaaaacgagcgggtcagctggcccgcttcagattgtgacatagtgcgctttgttcatgccggatgcggcgtgaacgccttatccggcctacaaaaacatgcaaattcaatagattgcagagattatgtaggcctgataagcgtagcgcatcaggcaattttgcgtttgtaatcagtctcgagcgggtcagtttactggcccgctttttttatgcgttattattgctgaagtgcttaatgccaaatcatcaatgcaatcaggctgaccaccaccagaccacacaatgcgctggtcagaataaactgccgacgcacccgctcacagcggcgaataaattcatcatcgtgatgatcgcgataacgttgggcatagatataccaaacgagacgcacctgtttgttgggttggccatgtgaggtaaaaaagccccctccatcaacatattgatagagcaatggatcgcagttacgcagtaccactaacaacgcgcgtagtgatgagaaatagcgcgccatgttaacaatgcaaacgacacataaagcccaaaataatgcgacggtgcttatcatacctcctccccggcgacctgcccgcggagttccaccccggggctaccgctcccgatacgctgccaatcagttaacaccaggtcctggagaaaccgcttttgtggtgaccaacatacgagcggctctatagatagtgtaggagatcaggttgttttttttccagaaggttaaccactatcaatatattcatgtcgaaaatttgtttatctaacgagtaagcaaggcggattgacggatcatccgggtcgctataaggtaaggatggtcttaacactgaatctttacggctgggttagccccgcgcacgtagttcgcaggacgcgggtgacgtaacggcacaagaaacgctagctggccagtcatcgacaactttatggaaggagtaacactatggcttataaacacattctcatcgcggtcgacctctccccggaaagcaaagttctggtagagaaagcagtctctatggctcgcccctacaatgcgaaagtttctctgatccacgtagatgtaaactactctgacctatacaccgggcttattgatgtgaatctgggtgatatgcagaaacgcatctctgaagagacacatcatgcactgaccgagctttccactaatgcaggctacccaatcactgaaaccctgagcggcagcggcgacctgggccaggttctggtcgatgcaatcaagaaatacgatatggatttggtggtttgtggtcaccaccaggacttctggagcaaactgatgtcttccgcacgtcagctgatcaacaccgttcacgttgatatgctgattgttccgctgcgcgacgaagaagaataatcttccctctacgacgtgttcctgaacgcccgcatatgcgggcgttttgctttttggcgcgccttgttacctgatcagcgtaaacaccttatctggcctacggtctgcgtacgcaatcaaaatccccagccaatacaacatttaacaccatcatattttccatcattagtgtgatcatctggttattttctgttgtaatagtgtattaatctattcaccgcatcaatattaagaatctctgacagatgtaaactttttcgcgcgttatcccttacgcgttcatacttttcaggatggtattggaaggttaataaatatgaatacaacaacacccatggggatgctgcagcaacctcgcccatttttcatgatcttttttgtcgagttatgggagcgattcggctactacggcgtgcagggcgtactggcggttttcttcgttaaacagcttggattctcgcaagagcaggcttttgtcacttttggtgcttttgctgcgctggtctatggcctcatttccattggcggctatgtcggcgaccacctgctggggaccaaacgcaccattgttcttggagcacttgtgctggcgattggctacttcatgaccggcatgtcgctacttaagcctgacctgattttcatcgccctggggactatcgctgtcggtaacggcctgtttaaagctaacccagccagcttgctttcgaagtgctatccgccgaaagatccgcggcttgatggcgcattcaccctgttctatatgtcgatcaacatcggctcgttgatagcgttatcgctggcccctgtgatcgctgatagattcggttattcagtcacctacaacctgtgcggggcggggttaattatcgcattactggtttacatcgcctgtcgtggaatggtgaaagacattggttctgaacccgacttccggccaatgagcttcagcaaactgttgtacgtgttacttggcagcgtggtgatgatcttcgtatgcgcatggctgatgcacaacgtagaagtcgccaatctggtgctgattgttctctccatcgtcgtcaccatcatcttctttcgtcaggcattcaagctggataaaaccgggcgcaataaaatgtttgtcgcctttgtcctgatgctcgaagcggtggtgttttacattctctacgcccagatgccaacatcgctgaacttctttgccatcaacaacgtgcatcatgaaattctcggtttttccatcaacccggtcagcttccaggcgcttaacccgttctgggtggtactcgccagcccaatactggcaggcatttacacgcatctgggtaacaaaggcaaagacctctcgatgccgatgaaatttactctcggcatgtttatgtgctcactgggctttttgacggcggcagctgcgggaatgtggtttgcggatgcacaagggctgacatcgccatggtttatcgtgctggtgtacttattccagagcttaggtgaactgtttattagcgcccttggcctggcgatgattgctgccctggtgccgcagcatttgatgggctttattctcgggatgtggttcctgacgcaggctgccgcgttcttgctgggcggctatgtggcaacatttaccgcggtgccggacaacattaccgatccgcttgagacgttgcccgtctataccaacgtgtttggtaagattggtctggtcacgctgggcgttgcagtagtgatgctgttgatggtgccgtggctgaaacgcatgattgcgacgccggaaagccattaattattcttgcagaaagcagggtagcgttatcgctaccctgttttagttttacactggcgtacctgcatagatatcaaagcgatgccctttagtgactaccgcgtttggcgtggcgacattcgccagcggtggcgcgtagtccgggcgctttaccaccacgcgtttggtcgccagcaagcgtgcaggctccagtaatccatcggcatcaagatccggtcccaccagcgactgaaagacacgcatctcttttttcactagcgcgcttttctgcttatgcgggaacatcgggtcgagataaaccacctgcgggcgcggggtaatatcagtcagcgccgtcaggctggaggcgtgaattaactgcaaccgctcctgcaaccagccgccgatttccgcatccgcataaccacgcgccaggccgtcgtcgagtagcgcggcaaccactggattacgctccagcatccgcacgcggcagccgactgaagccagtacaaaggcatcgcgcccaagtcctgcagtggcatccaccacatccggcaaataatcgcctttaatgcccaccgctttcgccaccgcctcaccgcgaccaccgccgaatttgcgtcggtgcgccatcgctccgccaacaaaatcaacaaagatgccgccaagttttggctcatcacgcttgcgcaattccagatgttccggcgttaacaccagcgccatcaggttgtcttcatcgtgctccagcccccagcgggccgccagaacagataaggcaccgtctccggtgcctgtttcatcaattaagcagattttcactgaatgatcagcccttaatgccgtaatgctccagcatcgcatccagctgcggttcacgaccacggaagcgtttgaacagatccatcggctcttctgaaccgccacggctcagaatgttgtcgaggaacgactgcccggtttcacggttgaaaatgccctcttcctcaaagcgcgagaaagcatctgccgccagtacgtcagcccacaggtagctgtagtaacctgcggcataaccaccggcgaaaatatggctgaaagcgtgcgggaaacggccccaggacggagatggcaccacggcaaccagtttcttgatttctgccagagtttcgaggatttttgccccctgatccgggcggaactcggcatgaaggcggaaatcaaacaggccgaactccagctgacgcagaataaacagcgccgcctggtagttcttcgccgccagcattttatccagcaactctttcggcagcggttcgccggtttcatagtgaccagagataaacgccagcgcctccggctcccagcaccagttttccataaactgactcggcagttcgaccgcatcccacggcacaccgctgataccggaaacaccagcggtttcgatgcgggtcagcatatggtgcaggccgtgaccgaactcgtggaagagggtgatcacttcgtcgtgagtgaacagcgccggtttaccatttaccgggcggttgaagttacaagtcaaatacgcgaccggtttttgcaaagaaccatcagctttacgcatctggcctacgcagtcatccatccacgccccgccgcgcttgttttcacgggcatacagatcgaggtagaagctaccgcgcagttcgttattttcgtcatacagttcgaagaaacgtacatccggatgccagacatcaacatctttacgctctttagcggtgatgccgtaaatacgcttaaccacttcaaacaggccgttaaccgctttgttttccgggaagtacggacgcagctgttcgtcactgatgctgtagaggtgctgtttttgtttttcgctgtagtaagcgatatcccacggctgcaactcatcgacgccaaattcggctttggcaaaggcacgcaattgcgccagctctttttcgccttgtggacgcgcgcgttttgccagatcggttaagaaatccagcacctgctgcgggttttctgccattttagtggcaagggatttaaaggcgtagttttcaaagcccagcagttgcgccagttcgtgacgcagcgcgaggatctcttccatcaccttgctgttatcccatttaccggcgtttgggccttgatcggaggcgcgggtgctgtaagcgcgatacatctcttcacgcagagcctggttgtcgcagtaggtcattaccggcaagtagcttgggatatccagcgtcagcaaataaccttccagctctttcgcttcggcctgggcttttgccgcagccagcgcgctttctggcatccccgccagctccgcttcgtcggtaacgagtttggtccagcccattgtcgcatcgaggacgttgttgctgtactggttgcccagttcagaaagacgggtcgcaatttcgccgtaacgctgctgtttctctttcggcagacctatgccagagagttcaaagtcgcgcagtgcgttatcaaccgctttcttctgcgccgtgttcagcgtggcgtaatgatcgccatcgcgcaggtcgcgatacgctttatacagcccttcatgttgccctacccaggtgctgtattccgacagcagcggcagggtttgttcgtaggcttcacgcagttccgggctatttttcaccgagttcaggtggctgaccggggagaagatacgccccaacacatcgtccacttccgccagcggctggcagagattttcccaggtgtacggtgccccttgcgctactacgcgctccacgttttcgcggcagtcgttcaatgccttagtcacggctggaacgacatgttccgggagaattttagaaaacggaggcaattcaaagggagtcagtaacggattcgtcattcgcgcagtcctggttaaagaggttaaggaagcgctcaacaggcgctttacataatgtgtgtagcatggggttaagtgtagtgaatttcaatgagaaacgttacgctttcgcggcggcggcctcttttcggtatactgtcctgatacgcttttgtgcgccccgaatacgggccgatttttacttaccggaacacctttacccatgctcagttatcgccacagctttcacgctggcaaccacgccgacgtccttaaacataccgttcagagcctgatcatcgagtcgctgaaagagaaagataaaccgtttctctatctcgacacccacgcaggggccgggcgttatcagttaggcagcgaacatgccgagcgtaccggcgaatatctcgaaggcatcgcccgtatctggcagcaggacgatttgcccgcagaactggaggcgtacatcaatgtggtaaaacacttcaaccgtagcggtcagttgcgttactaccccggttcgccgttgattgctcgcctgctactgcgtgaacaggacagcctgcaactgaccgaactgcacccgagcgattacccgttgttgcgttctgaatttcagaaagatagccgtgcgcgtgtcgaaaaagccgacggtttccagcagcttaaggccaaactgccgccggtttcccgccgtggtttaatccttatcgacccgccgtatgaaatgaaaactgactatcaagcggtggtcagcgggatagcagaaggttacaaacgtttcgccactggtatttacgcactgtggtatccggtggtgctgcgtcagcaaattaagcgcatgatccacgatctggaagcgaccggtattcgcaaaattctgcaaattgaactggcggtactgccagacagcgatcgccgtggcatgaccgcttccggcatgattgtgattaacccgccgtggaaactggaacaacagatgaataacgtgctgccgtggctgcacagcaaactggttccggcaggcaccgggcacgccaccgtaagctggatcgtgccggagtaattgcagccattgctggcacctattacgtctcgcgctacaatcgcggtaatcaacgataaggacactttgtcatgactaaacactatgattacatcgccatcggcggcggcagcggcggtatcgcctccatcaaccgcgcggctatgtacggccagaaatgtgcgctgattgaagccaaagagctgggcggcacctgcgtaaatgttggctgtgtgccgaaaaaagtgatgtggcacgcggcgcaaatccgtgaagcgatccatatgtacggcccggattatggttttgataccactatcaataaattcaactgggaaacgttgatcgccagccgtaccgcctatatcgaccgtattcatacttcctatgaaaacgtgctcggtaaaaataacgttgatgtaatcaaaggctttgcccgcttcgttgatgccaaaacgctggaggtaaacggcgaaaccatcacggccgatcatattctgatcgccacaggcggtcgtccgagccacccggatattccgggcgtggaatacggtattgattctgatggcttcttcgcccttcctgctttgccagagcgcgtggcggttgttggcgcgggttacatcgccgttgagctggcgggcgtgattaacggcctcggcgcgaaaacgcatctgtttgtgcgtaaacatgcgccgctgcgcagcttcgacccgatgatttccgaaacgctggtcgaagtgatgaacgccgaaggcccgcagctgcacaccaacgccatcccgaaagcggtagtgaaaaataccgatggtagcctgacgctggagctggaagatggtcgcagtgaaacggtggattgcctgatttgggcgattggtcgcgagcctgccaatgacaacatcaacctggaagccgctggcgttaaaactaacgaaaaaggctatatcgtcgtcgataaatatcaaaacaccaatattgaaggtatttacgcggtgggcgataacacgggtgcagtggagctgacaccggtggcagttgcagcgggtcgccgtctctctgaacgcctgtttaataacaagccggatgagcatctggattacagcaacattccgaccgtggtcttcagccatccgccgattggtactgttggtttaacggaaccgcaggcgcgcgagcagtatggcgacgatcaggtgaaagtgtataaatcctctttcaccgcgatgtataccgccgtcaccactcaccgccagccgtgccgcatgaagctggtgtgcgttggatcggaagagaagattgtcggtattcacggcattggctttggtatggacgaaatgttgcagggcttcgcggtggcgctgaagatgggggcaaccaaaaaagacttcgacaataccgtcgccattcacccaacggcggcagaagagttcgtgacaatgcgttaaatgttaaagggctaagagtagtgtgctcttagcccttaattacgtttccgctatcagttcagaagctgaagcagaaagcggatcagttccagcagcgcaattaacgcccctagaacgatgattgctttatcaatcacccgttttctccatgcgatggagtgagaatgcatccgcttactcatccactgcctgtcacggcgcatgtctcattgttagataagaactctctcactccggccagagcatcagttaacggcaccacccgtacttctgaccaggactttgaaagcgtttatgcgcattgccagagtgaaaatgcctcagagctaactggataatcatacagtacatgcaggttataaaaccagcacgtccttgcaatagtttcagtatggtattagcattgatgcgttagatgatggctatctcactccagtcagagccaccaactcagggctggaaagtaaaaaaccgacgcaaagtcggtttttttacatccggattcggacaaggcttaatatgacgatgacccagtgaaagtatataaatcgtcactgcgatatataccgaagtgctccctccgccagctgaagaaatcgctaattcttgcaatgttagccactggctaatagtattgagctgttagataagaactctctcactccagccagagccaccaactcagggctggaaagtaaaaaaccgacgcaaagtcggtttttttacgtcctgattcagacctcctttcaaatgaatagccaactcaaaattcacacctattaccttcctctgcacttacacattcgttaagtcatatatgtttttgacttatccgcttcgaagagagacactacctgcaacaatcaggagcgcaatatgtcatttctgttacccatccaattgttcaaaattcttgctgatgaaacccgtctgggcatcgttttactgctcagcgaactgggagagttatgcgtctgcgatctctgcactgctctcgaccagtcgcagcccaagatctcccgccacctggcattgctgcgtgaaagcgggctattgctggaccgcaagcaaggtaagtgggttcattaccgcttatcaccgcatattccagcatgggcggcgaaaattattgatgaggcctggcgatgtgaacaggaaaaggttcaggcgattgtccgcaacctggctcgacaaaactgttccggggacagtaagaacatttgcagttaaaaatttagctaaacacatatgaattttcagatgtgttttatccgggaggcattatgttactggcaggcgctatctttgtcctgaccatcgtattggttatctggcagccgaaaggtttaggcatcggctggagtgcaacgctcggcgcagtactggcgttagttacgggcgtggtccatccgggtgatattccggtggtgtggaatatcgtctggaacgcgacggctgcgtttatcgccgtcattatcatcagcctgctgctggatgagtccggcttttttgaatgggcggcgctgcacgtctcacgctggggtaatggtcgtggtcgcttgctgtttacctggattgtcctgctcggtgctgccgttgccgccctgtttgccaatgatggcgcggcgcttattttgacaccgattgtcatcgccatgctgctggctttagggttcagtaaaggcactacgctggcgttcgtgatggcggccggattcattgccgataccgccagcctgccgcttattgtctccaacctggtgaatatcgtttccgctgatttctttggcctcggctttcgcgaatacgcctcggtgatggtgccggtggatatcgccgcgattgttgccacgctggtgatgttacatctctattttcgcaaagatattccgcagaactacgatatggcgctgctgaaatctcccgcagaagcgatcaaagatcctgctacgttcaaaactggctgggttgttttactgcttctgctggtgggatttttcgtcctggaaccgctcggcattccggtgagcgccattgcagctgtgggcgcgctgatattatttgtcgtcgctaaacgcggtcatgcgattaatacgggtaaagtcctgcgcggtgccccctggcagattgtcatcttctcgctcggcatgtatctggtggtttatggcctgcgcaatgccggattaacggaatatctttctggcgtactcaacgtgctggcggataacggcctgtgggccgcgacgctcggcaccggattcctcaccgccttcctctcttctattatgaacaatatgccgacggtactggttggcgcgttgtccattgatggcagcacggcatctggcgttatcaaagaagcgatggtttatgccaatgtgattggctgcgatttgggaccgaaaattaccccaattggtagcctggctacgctactctggctgcacgtactttcgcagaagaatatgactatcagctggggatattacttccgtacagggattatcatgaccctgcctgtgctgtttgtgacgctggctgcgctggcgctacgtctctctttcactttgtaatgagatactgatatgagcaacattaccatttatcacaacccggcctgcggcacgtcgcgtaatacgctggagatgatccgcaacagcggcacagaaccgactattatccattatctggaaactccgccaacgcgcgatgaactggtcaaactcattgccgatatggggatttccgtacgcgcgctgctgcgtaaaaacgtcgaaccgtatgaggagctgggccttgcggaagataaatttactgacgatcggttaatcgactttatgcttcagcacccgattctgattaatcgcccgattgtggtgacgccgctgggaactcgcctgtgccgcccttcagaagtggtgctggaaattctgccagatgcgcaaaaaggcgcattctccaaggaagatggcgagaaagtggttgatgaagcgggtaagcgcctgaaataaagcggcgatatcccccccacaggttgttagaaaagtgcgctttatttatgtcggatgcgacgctggcgcgtcttatccgacctacaaagttatgaaaattcgatgaatagtatgttatttgtaggcctgacaggcgtagcgcatcaggcgattttgctatttacacagtactccctgcgtgagattccaattatcgcgtccagcatggtgtatcagtgagctgcttagttatcagcgatacagcgcagtagtttaaagacgtactggattatgatttatcagtggtttacacaacaaattattaaataattataagataccttaacccattttattattacacatctaaaacatcacaaaaaaaatcacttcacacactatcagagaacataataactttttaaaatgagcgcattttgatagttgttaacgatttcctttacgatactatcactaccctttttttacacacaaatattaccgggtggagataaaagggaaatcaaaggtaattatatcaggaagatataacgcattacatttattgtgtgtagaagaaaatccattcctgttctaattatccaatttaaacatcttagcataaaacaaatgatgaataaggaattttatgtcaattgactttaccccaggtataataaatacatatcacggcgatatttataactgcacaacaaataccgataatgctaaaacgccagacacaccgaagtggccttgcgataattgggaagaacaacaacccattaattccacattctctggagaaggatatatctctgatcaatatgatttagcgcaacaccaacttcaacaaattaatgcgtgccacacgaacactacatatacaaatgcagactactcaaaagttgtggctcaacttgtaagtcttattactaacattgaaacgataagttcgacacaacttacgcaacagacacaatcaatacttaatcagattaataacattagatatgaaaaaaacaaaagtgctgaatgtcgaatcattgttatcgctaatcctaaacccgacaaggcaatcataactaaaattagcgtagaagagggaatacccataacattcagtgtccaaaccatgttttcagatactaattttattgctgaacaacgagctgacttaccaactaatataaaagatattcaaagcctgtatcaaaaaatgacgaagttatatattgagcacagtgaaaataaaaacaggatgaaagtctttgccggaaccaactttattgatttcaatatgacaggacagaacctgtccgggttcgttctaaccttgtcaaggttttatttcgaagatctacttaatataaatttcactgacgcaaatttagggaaggtgcgaataagcggggaaattcttctcggctgactcagtcatttcatttcttcatgtttgagccgattttttctcccgtaaatgccttgaatcagcctatttagaccgtttcttcgccatttaaggcgttatccccagtttttagtgagatctctcccactgacgtatcatttggtccgcccgaaacaggttggccagcgtgaataacatcgccagttggttatcgtttttcagcaaccccttgtatctggctttcacgaagccgaactgtcgcttgatgatgcgaaatgggtgctccaccctggcccggatgctggctttcatgtattcgatgttgatggccgttttgttcttgcgtggatgctgtttcaaggttcttaccttgccggggcgctcggcgatcagccagtccacatccacctcggccagctcctcgcgctgtggcgccccttggtagccggcatcggctgagacaaattgctcctctccatgcagcagattacccagctgattgaggtcatgctcgttggccgcggtggtgaccaggctgtgggtcaggccactcttggcatcgacaccaatgtgggccttcatgccaaagtgccactgattgcctttcttggtctgatgcatctccggatcgcgttgctgctctttgttcttggtcgagctgggtgcctcaatgatggtggcatcgaccaaggtgccttgagtcatcatgacgcctgcttcggccagccagcgattgatggtcttgaacaattggcgggccagttgatgctgctccagcaggtggcggaaattcatgatggtggtgcggtccggcaaggcgctatccagggataaccgggcaaacagacgcatggaggcgatttcgtacagagcatcttccatcgcgccatcgctcaggttgtaccaatgctgcatgcagtgaatgcgtagcatggtttccagcggataaggtcgccggccattaccagccttggggtaaaacggctcgatgacttccaccatgttttgccatggcagaatctgctccatgcgggacaagaaaatctcttttctggtctgacggcgcttactgctgaattcactgtcggcgaaggtaagttgatgactcatgatgaaccctgttctatggctccagatgacaaacatgatctcatatcagggacttgttcgcaccttccttaggtgacactatttttttacataaagaacaccctacccccaaattatataaagatggacaatatcttgacaaacaaatcgaaggtttattttcaacattattaaccattaatgacaaccttttacgagcaaaagcggaaattgcttcgacaataattaaatttttagaggccaggataaccaatctttcatacaatgacatattaaaatatcagcaagaattccaaagacaatgttataagcaagttaaagcctttacgacactctcccgatacaataaaattcaaacatgggcagaaatgtctgaatatcaattcgaagtatttcaatacgagacgcttaacccaaaaaaaatgtcacacacgccttatttaaagaggccactgcctaatgaaaaagatataaattatggggtggaaatagaaataccatctggtaaaagaattcgcttatcaaatcattaccagaatataataccataatattgattattagcactttataatcattgaataaaaatagattttatgtacttttaaaacaatgcactatattatggggtgatggatattcatgtcacgccccaaaattaactgagttcacctaaacagaaaggatataaacatcagacaggtttacgttactatcaggcatatcacctcagaatcagatgaaaactataaagaaatatctattatggttttaatatttgttgataaggatagtaacatgaacatgacaaaaggtgcactcatcctcagcctttcatttttgcttgccgcatgtagttcaattccgcaaaatatcaaaggcaataaccaacctgatattcaaaaaagttttgttgctgttcataaccagccggggttatatgttggtcaacaagcgcgctttggtgggaaggttatcaacgttatcaatggcaaaacggatacgttgttagaaatctctgtattaccgttggatagctatgcgaagcctgatattgaagccaactatcagggccgactgctcgccagacaaagcggcttccttgatccagtgaactatcgtaatcactttgttaccatcctcggcaccattcagggtgaacaacctggctttatcaataaagtcccgtataacttcctggaagtgaatatgcagggcatccaggtgtggcatttgagagaagtggttaataccacctataacctgtgggattacggctatggtgcattctggccggaaccgggctggggtgcgccttactacaccaatgcggtgagtcaggtaacacctgagctggtcaaataacaccaccgaaagatgcagatgctttctcagcatctgcatcatgcattacatcaaattaatacacagtaagctaactattattattataagccctgtcctgttaattacctttggcaaactgattataaagttaatgtccgcaccaggagtcggttatgtttcttataattaccagggatacgatgttcttcaccgcgatgaaaaacattctgagtaaaggtaatgtcgttcatatacagaacgaagaagagatcgacgtaatgttgcatcagaatgccttcgtcattattgatacattaatgaataatgtatttcattctaattttctcactcaaattgaacgattaaaacctgtccatgtcattattttctccccctttaatattaaacgctgcctggggaaagtgccggtgacctttgttccgcggactatcactatcattgattttgtcgcactcatcaatggcagttactgctctgtgcctgaagcggctgtgtcactttcgcgcaagcaacatcaggttctgagctgcattgcgaatcaaatgacaacggaagatattctggagaaactgaaaatatcgctaaaaacgttctactgccataaacacaatatcatgatgatcctcaatcttaagcggatcaatgagctggtacgccatcagcatattgattatctggtgtgaatttcaggcttacggtgagtctggctacgctgccacacagattagctaattgaaacgcctttcacccctgccataccttttaataatcgcaacaggtcttctatcgacgttgtggcatgaagctggatatcaatggcgaccacttcatgatcttcattttcctgcaacgaaactaaatcagtttttattttttgctgcttaaaccagtcgagcattgataccgtattaccgttcactaatgtcagctgtaaatggtaatttttgttcatcaggcggaaggttaattgatggaagacttccagcaccaacaaggtcatcactgaaccataaatacccagttcgtacataccgctgccaataaccatacctatggcggcggtcacccagatatccgctgccgtcgtcagacctacaatattttggttacgaacgagaatgttacctgcaccgataaacccgacgcccgtcaccacctgagcagcaatacggctggggtcgagtccgacgtgatctaaagacagcacgtcagcaaaaccatatttcgaaacaatcataaacagggcgcttcccatgccaattaatacatgtgtgcgtaaccctgctcctttgccgcgcatttgcctttccatgccaatagcgccacaggcaattgccgcgagtataagacgtataataaattctgctgtcatataaaaatgcaaaaaggagcagcaagatggctcaacttgctactcctttttacttgcacctcattaattcggcaagtcattagatgcttgatttttgaaggtatacaaatttttctgcgggtttttcttacagtattcgatcactttaggaatttgagtgagatcggtttcatttaaagtaacggtatcgccacctttatatactgtttcttcatgcagcatccaccatgcaaccggggtcattgcttttggattcagatcaataaattcctggcaggtcatatctttagcggattcattggctgccaacgcagattgtgcgttcaccagtgacaaagccgctacagcgcccataaaaataaacgctttacggagagatgaaatattcattttgtaacccattcaatatagagattatatatgaacaggaggaatagctgcttttaaagaagatattccggcctgttcaatatgcaaggaagtacgatgtaacgcattcccggaattacatatctttcttaattttgtcccattcgcctttaactttatctttaaagttggcttgtttatcctgagtacaagcctgaacgatagctggggttacggttgcaataccctgaacatctaaaaccgcatcttctggtttatctttgttgttcagcgcttcagcaaaaccaactgcagttggctggaaggattcgtccacagccaggaaatcttcacaggtccaggagttgaccggttttttgttatcagctgctttttgcgcatccgctgcattgctcacaactggcagaagaagcagaccaccaagaataacgcctaatacttttttcatcgtaatatcctcaactataaagtgaaagagccgtcacgaatcaatttcgacactgaggttataacctggttttctgtatatgtcatgttgatggaaaatatcaaaatcagatatttttatttcaatacaatgagttacagatgcatcagatactgcaattaggaaatttttattaaatcgactgcattcttagacgcgtttttggcatagattgatagcaggggattttcttcttaattttatagggtggttctatgttatatatagataaggcaacaattttgaagtttgatctggagatgcttaaaaaacatcgcagagcaatccagtttattgccgtgctgctgtttatcgtcgggttgctgtgtatcagtttcccgttcgtctctggcgatattttaagcacagtagtgggtgcattattaatctgctcgggtattgcgcttattgtcgggttattcagcaaccgcagtcataatttctggccggtattatccggtttcctcgtcgcagtcgcctatttattgatcggctatttcttcatccgcgcaccggagctgggcatttttgccattgcggcatttattgccggtttgttctgtgttgcaggggttattcgcctgatgagttggtatcgtcagcgttcaatgaaaggcagctggctacagctcgttattggtgtgctggatatcgtcattgcctggatattccttggtgcaacgccgatggtgtctgtaacgctggtttccacactggtgggaattgaactgatatttagcgccgccagcctgttcagcttcgccagtttgttcgttaagcagcaataattaccccggttgtcacccggatcatagtcacttgatgtgactatgatccgattaatactctctccgctacgcagtgttgtagatcaattgcgcactatcattgaaataattacctgctagtgattatttcaacctactgaatttcatctaatttttttcactctatggcaaattagccatttcaaacattatcatggctgatattttccgtagtcaggtttaatgttttaaaagtgctgtgggaaagtgaacaaagagttccgtaagcgttgatgctatgggcggttaaataagtaatccgggttcatttttttgcaactggcgttgattacattgcataaatatccgtgtctccagacgctatataaaaacctgaagacatgaatgcgttatttactcaggtaatttcaatgcgttaaaagaaagctggcaatccaattgccagcttaagtcgaaacaaggagactcgatatttaaatcggattacattttaactttagtaatattcttcagagatcacaaactggttattgataacttattcttgggcagtaatccgcaaacgttaactttttgtttgctatttacaagctgataacaaccaggaatcttacttaggatcaatatatggagtgcgtgatggataaatctgaagtattgattagtgttaatagacgtattagttcacgaagggtaaagttcttataggcgtttactatattgaacaacgattcggacaaggatgtaaataatgaaaaggatgacatattcgaaacgataacggctaaggagcaagttatgatttttctcatgacgaaagattcttttcttttacagggcttttggcagttgaaagataatcacgaaatgataaaaatcaattccctgtcagagatcaaaaaagtaggcaataaacccttcaaggttatcattgatacctatcacaatcatatccttgatgaagaagcgattaaatttctggagaaattagatgccgagagaattattgttttggcaccttatcacatcagtaaactaaaagctaaagcgcctatttattttgttagccgcaaagaaagtatcaaaaatcttcttgagattacttatggtaaacacttgccccataagaattcacaattatgtttttcacataatcagttcaaaattatgcaactgattctgaaaaataaaaatgaaagcaatatcacgtcgacgctcaatatttcgcaacaaacattaaagattcagaaattcaacattatgtacaagctgaaactaagacgtatgagcgacatcgtcaccctgggtatcacatcttatttttagtcaggacataagcaactgaaattgatggctggcatgacgagggatgcagatgctgatttcattacccccggtgattactaaaggagaggctaaaacgactttattcccctggtatgtgtatccaccagtagaacccttcgttgcccgaatgctggcaggaactgttggcagaacggcaacattttttttgtcgttgacctcaccatgtcgatcactgtgcctgtatcccaccttactggctgacaaccccactatgccgctggtctgtaaatccctcatatctctcctcgcgcgcaatttaaagaaccgttatttctcaagaattttcagggactaaaatgaacagaagaagaaagctgttaataccgttgttattctgcggcgcgatgctcaccgcctgcgatgacaaatcggcggaaaacgccgccgccatgacgcctgaggtcggtgtcgtcacactctcccccggttcggtcaatgtgttgagcgaattgcccggtagaaccgttccttatgaagttgccgagatacgtccccaggtgggcggtattatcattaaacgcaactttatcgaaggcgataaagtgaaccagggcgattcgctgtatcagattgatcctgcacctttacaggccgagctaaactccgccaaaggctcgctggcgaaagcgctctctaccgccagcaatgcccgcatcacctttaaccgccaggcatcgttgctgaagaccaactacgttagccgtcaggattacgacaccgcgcgcacccagttgaatgaagcagaagccaatgtcaccgtcgccaaagcggctgttgaacaggcgacgatcaatctgcaatacgcgaatgtcacctcgccgattacgggcgtcagcgggaaatcgtcggtgaccgtcggcgcactcgttaccgctaatcaggcagattcgctggttaccgtacaacgtctggacccgatttatgtcgatctcacgcagtcggtgcaagatttcttacgcatgaaagaagaggtcgccagtgggcaaatcaaacaggttcagggcagtacgccagtacagctcaatctggaaaatggtaaacgctacagccagaccggcacgctgaaattctccgacccgacagtggatgaaaccacgggctccgtgacgttacgggcgattttccccaacccaaatggtgacttgctgcctggcatgtacgtcacggcattagtggatgaaggtagccgccagaatgtattactggtgccgcaggaaggcgtcacccacaacgcccagggtaaagcaacggcgctcattctggataaagacgatgtcgtgcagctacgcgaaattgaagccagcaaagccatcggcgaccagtgggtcgtcacctctggcttgcaggctggcgatcgggtgatcgtttccggtttgcaacgcattcgtccgggtatcaaagcacgagcaatttcctccagccaggaaaacgccagcaccgaatcgaaacaataacgttgcaggcttaaggggactttcatggctaactattttattgatcgcccggtttttgcctgggtacttgccattattatgatgcttgcaggtggtctggcgatcatgaacttaccggttgcgcagtatccgcagattgcgccaccgaccattaccgtcagcgctacctatccaggtgccgatgcgcaaacggtagaagactcggtcactcaggtgattgagcaaaatatgaatgggcttgatggcctgatgtacatgtcttcaaccagtgatgcggcgggcaatgcctctatcactctgaccttcgagactgggacatctcctgatatcgcacaggttcaagtgcaaaataaactgcaactcgctatgccttcattacctgaagcagtgcagcagcaggggattagcgtcgataagtcgagcagtaatatcctgatggtagcggcgtttatttctgataacggcagcctcaaccagtacgatatcgcggactatgtagcgtctaatatcaaagacccgctaagccgtaccgcgggcgttggtagcgtacaactctttggttccgagtatgccatgcgtatctggctggacccgcaaaaactcaataaatataacctggtaccttccgatgttatttcccagattaaggtgcaaaacaaccagatttccggtggtcaactgggtggcatgccacaggcggcagaccagcagctaaacgcctcgatcattgtgcagacgcgtctgcaaacgccggaagaatttggcaaaatcctgttgaaagttcagcaagatggttcgcaagtgctgctgcgtgatgtcgctcgcgtcgaacttggggcggaagattattccaccgtggcacgctataacggcaaacctgctgccgggatcgccatcaaactggctgccggagcaaacgccctggatacctcgcgggcagtcaaagaggaactgaaccgcttatcagcctatttcccggcaagtctgaagacggtttatccttacgacaccacgccgtttatcgaaatttctattcaggaagttttcaaaacactggttgaggctatcatcctagtcttcctggtcatgtatctgtttttgcagaatttccgtgccacaatcatcccgacgattgccgtaccggtggttattctcgggacgtttgcgatcttgtcggcggtcggtttcaccatcaacacgttgactatgttcgggatggtgctggcgatagggttactggtggatgacgccatcgtggtggtggagaacgtcgagcgtgtcattgcggaagataagctaccgccgaaggaagcgacgcataaatcgatggggcagatccaacgtgcgctggtcggtattgccgttgttctttccgcagtgtttatgccgatggcctttatgagcggtgcaaccggggagatctaccgccagttctccatcacgctgatctcctccatgctgctttcagtatttgtggcaatgagcctgacccctgccctgtgcgccaccattctgaaagccgcgccggaaggcggtcacaaacctaacgccctgttcgcacgcttcaacacgctgtttgaaaaatcaactcaacactataccgatagcacccgctcgctgttgcgttgtaccggtcgctacatggtggtctacctgctgatttgcgccgggatggcggtgctgttcctgcgcacgccgacctctttcttaccagaagaggatcagggggtatttatgaccaccgcgcagttaccttccggtgccaccatggttaacaccacgaaagtgctgcaacaggtgacggattattatctgactaaagagaaagataatgtccagtcggtgtttaccgttggcggctttggcttcagcggtcaggggcaaaacaacggcctggcgtttatcagtctcaagccgtggtctgaacgtgtcggtgaggaaaactcggttaccgcgatcattcagcgggcaatgattgcgttaagcagtatcaataaagccgtcgtcttcccgttcaacttacccgcggtggctgaactgggtaccgcgtcaggttttgatatggaactgctggacaacggtaacctggggcacgaaaaactaacccaggcgcgaaacgagctgttatcactggcagcgcaatcaccgaatcaggtcaccggggtacgcccgaacggcctggaagatacgccgatgttcaaagtgaacgtcaacgctgcgaaagctgaagcgatgggcgtggcgctgtctgatatcaaccagacaatttccaccgccttcggcagcagctacgtgaacgacttcctcaaccaggggcgggtgaaaaaagtgtatgtccaggcaggcacgccgttccgtatgttgccggataacatcaaccaatggtatgtacgcaacgcctctggcacgatggcaccgctttctgcctactcgtctaccgaatggacctatggttcaccgcgactggaacgctacaacggcatcccgtcaatggagattttaggtgaagcggcggccgggaaaagtaccggtgacgccatgaaatttatggcagacctggtcgctaaacttccggcaggcgtcggctactcatggaccggactatcgtatcaggaagcgttatcctcaaatcaggctcctgcgctgtatgcgatttcactggtcgtggtgttcctcgccctcgccgcactctatgagagctggtcaattccgttctcggtgatgttggttgttccgttaggcgtcgttggcgcattactggccaccgatctgcgcggcttaagtaatgacgtctacttccaggttggtttgctgaccaccatcgggctttccgccaaaaacgccatcctgattgtcgaatttgccgttgagatgatgcagaaagaagggaaaacgccgatagaggcaatcatcgaagcggcgcggatgcgtttacgcccaatcctgatgacctctctggcctttattctcggcgtgctgccgctggttatcagtcatggtgccggttctggcgcgcaaaacgcggtaggtaccggcgtgatgggcgggatgtttgccgcaacagtgctggcaatttacttcgttccggtctttttcgttgtagtggaacatctctttgcccgctttaaaaaagcgtaacgtgtaaatgagagtaaggttgaacatgaaggttcagccttactctttcctgctaaccattcaccactcaacaaccagctaaccgtcaggaataccaggcttagtacacagcactgaaagtagaaaccactccagccattcgtcatcaatttgaacaacacaatactgacccacattcccgtaatcgtatgaattgtcagcttaataatcccaaacatgccgagtcttttcctcctgaaaataccgataccgcctggcaaactgcgaaagagaactagccggtagcccggcagaaatcatcagggaagagtttcacatgaagcaggtgtgagatcctgaccaatattcaaatgcgaaatatgtcaggaaaaggtacctggcgaatgttgcgcaaactgatgtggcgttacaccataatattgtcgaaatgtgtttataaagtacgatgtactgctatagccacatttttccgcaatagtatgcagaggaatttgacgtaactcgagtaatcgtctggccatcgacatcctggaggcgagtaatattttactgaaacaggtattttcatcctgcaacttttttttgattagactctcgctggtatacattctttccgcgatatcgcgcagataccaacgtttggcgatatcaaagctaataaggcgttcaacttttcctgaaacagtgctgatgctattgaaaagtaaggggatcagttctttcttatgagaaaacatcgataaacaggaaaggtagagcatattgctcagtatcggtgaatttaccccggattcattgaagctatcaaaaatcgccgtcaccagcggcatggggggtgactggttaattaacaaacggtctttgctgtgtaaccctaaattgcgtggtagctgacgaatattttgtaagtaatggcaaactgtcagctcatcgatatccagtcgtcgcgtatccggtgaacaaaacgcaaaatcgtctgccaaatttttctccagcagcagaatactctcgttatgcagcgatattttttgctgttcatgataaatatcgaatgaacgacgaatgaggatcaccgagcagacatgagtcatgattatcccttatatttcatactgcgattatttcaatttcagtatactaatgaaatgatgccagactgtttcttagcgcaaaaactgccagatttggtaggaccaaaatttatccacaaagtagttttgcataacagttaattgataataagtaaatgcagcacgaatatattttcgcacagcgtatagcttatgtttataaaaaaatggctgatcttatttccagtaaaagttatatttaacttactgagagcacaaagtttcccgtgccaacagggagtgttataacggtttattagtctggagacggcagactatcctcttcccggtcccctatgccgggttttttttatgtctgagtaaaactctataatcttattccttccgcagaacggtcagtgccgtaaaaattcccttgcgcaacaatacttgccgccgagtcacggttcgacaatctctgcgccgatcgctcctgatactctgtgggcgtcatcccataataatttcgaaagacgtaaatgaaatacgacacgctgtgatatccacaggatactgcaactcgcttaattgaaaaaccatgtataacaataagttgcaaagcacgttgcattctacactcagtaagcaactgtgaatatgatgtctcttcttcgcgcaattttttctttaacagacttggactcatcaacagctcgctggcgattcgggctagtgtccactcatgggcgatattattattgataaccgtacaaactcgtgttcgcatgttcggttgtaaaacgttcagaagcagcggtataaagtgctcatcctcaagaaaaacagataacaacgcaaagattaatgctcttttacgtagcatttctgcatagcgaagattcttattctgcgatagttgcgcaacttcctgaaaaacaggaatatctctactacagtgatgaacgagtaatgaagaaacttttttatgtgcatgaagatttaatgcctcctccttgagcatcgggagaaataatgaaagcgtgtcccttgacacgaatacaaaattttcaacacacttatctactcgaatttggcttgcatccgcaaaaaccaggtcaccgccattaaaatagcgatattcaccattaaccatggtgagaatatatttatgtcttgcatacgcaattagacaattcccatgtagtgattgcatagttgacttaatattacataaacatattactgtttattaatgtagcacgccgccctcttaagtcaaattgattgataaataaatttaaacgaagcgggagaacaggatgataatgtgtgatgttctacgggcaggatgactggatttataatacaaaaacgtgtttaagaacacagggaaattaatagtaagcaaataatcccttttcgtgacattaaaggtaatcgctacatttaataaacattcatataacatatatcttatcaacacgatgaatagacagccaatatattattgcgattaataagcaaccgaatgcccagctgtttttttaaaggctgggcattcggtttttacaacgttatgttatcaggtgtgtttaaagctgttctgctgggcaataccctgcagtttcgggtgatcgctgagatatttcagggaggctttgtagtcttccagcaacagttcagcaaagtccatttcgaagccgcgacgacacataatgcgcatcaccacgatgtcggtggcttcaccgccgagagtgaaggccggaacctgccagccgcgcagacgcagacgttcagagaggtcgtacagggtgtatcccggatcttcaccatctttcagtttgaagcaaaccgccgggatgccttcgtccgggcgacccgtacagatgaactcatacggccccagtttggcgatttcatccgccagataagcggcaacctggtaagaggcgttctgtactttggtatagccttcacgaccgaggcgcaggaattcatagtactgtgcaattacctgacccgccgggcgggagaagttgatggcaaaagtaccaatttgaccacccaggtagtcaacgttgaacaccagttcctgcggcagcgcttcttcgtcacgccagataacccagccgcagcccagcggagccagaccgaatttatggcctgaagcactgatcgatttcacacgcggcaggcggaagtcccagacgatatccggggcgacgaacggtgccaggaagccaccgctggcagcgtcgatgtgcatgtcgatgtcgataccggtgtcggcctggaatttatccagcgcatcgtgcagcggttgtgggaactcatagttaccggtgtaggtcacgccgaaagtcggcaccacgccgatggtgttttcgtcacaggcttcaatcatgcgtttcgggtccataaacaactgaccggggcgcatagggatctcacgcagctccacatcccagtagcgggcgaatttatgccagcagatttgtaccggaccgcacaccaggtttggtttatccgttggtttgcctgcagcttccatacgcttgcgccaacgccatttcatcgccatcccgccgagcatacaggcctcggaagaaccaatggtgttggtgccaacggcctgaccatttttcggcgcaggcgcatgccacagatcggcaaccatatttacgcaacgcaggtcgatggctgcggattgcggatattcttctttgtcgatccagtttttattgatcgacaaatccatcaatttatggacgttttcgtcgtcccaggtctggcagaaagtggccaggttctgacgagcgttgccatcaagatataattcatcattgataatctgaaatgcgacatcatcgcgcatttcgtgcagcggaaatcgttttgactccgcgatagtagaaatggcctttgcgccaaaacgtgaatcgagtagttctgagcggaaatccgttaacagcttctggtccatttcgaactccttaaatttatttgaaggcaataaaaaagtaggatttatccgcaatggaagcaaggcattacaggcttaatttaaataacaaaatcctaagcagaaaaacgactttttataatataaacatttaacatgataatattaaaaacagactttattatcgtaataaaaatcgcccaaacattgctgttcgggcgatcaaattaattattgtttatcctgcatatacggcgtgtacaccccgttcagactgtgcaggaaagctacgatatcatccacatcctcctgcggcagctctttgcctacctgatagcgcagcatcagtttcaccgccccgtccagcgtcggcacgtcaccgcgatggaagtacggtgccgttaaagcaacgttacgtaaaccgggtactttctgacgcaatttatcacgctcttctttagtcacattcatacgaccaatatccgccgccgtaatttccccaaagttaaagtcttttttcagccccaacggttcaaaggaacgtccgccgagaataataccaccatgacaagttgcacatttattatctttaaataattgatagccttttttctgttgcgccgtcagcgcattttcatctccgcgcaaccatttatcaaatggggaatccggcgtaattaatgttttctcaaattcagcaatggcatcagtaatattttcgccactgaaaccttgcggatagacttcgaggaactgcgttttaagctgcggatctttttccagcttagcaataatttcgtcccaggatttcgacgccatttcaatcgggttcaacggcggtccaccagcctgatcctgcaatgttgccgcacgaccatcccagaactgctcaacgttaaatactgagttaaataccgtcggcgcgttaatcggcccaactgcgccaccaacaccaatcgatgtttttctgccatcgacgccccccgcattcaacgcatggcaatgagcgcatgaaatggtgctatcagccgataaacggggatcgtgatacagcgcaaaacccaacgccactttttgcgcatcggtaggcagtttttgcgggatgggctgcaccggttcattgcgatgttccggagcagtatcattgctggcgtaatattccgcgcgctgttttgcaatccaggccagtatttccgcccgctcttcatcactcaccttacccgcccagtgtagcgcggtataacgcgttggtggcatagtttcatactgcatcacccattcaatcttattcaaatcgctttgcgaaacgggtttatcagccagcagtgccgcacgcacggcctcaaggttaaaagatttatatccaagcttaatgtcgtaatccatcaactgtttcgcgccaggaatataataataggcgggtaattctgccgaaggcgtgtggcaatagtcgcatcctttttcgcggagaaagcctaaaaccttattattttcactgacagcagatgcctgaacatcggcctgtttactgcgtttattatcgtggtaccacacataaccagataaccctaaatagcaaatcgcgacgccagccaggccgatcgcggtaatacgtgagaccattttcattattcttccctcacggtggtgagttattgtgacccagaaaattttccagaatgctgcaaacgtctctgcgagacaaagccatcataaaaaacagggagatacgctttttgataggaatcaatcaattacatgaatataaactatcaataagatagcctgtgcctattacccagatcaggaatggcatatcatgattgcggcgagagcaggattgaatgttctgaaaatgaaaaacaacaccaaatcggtatttttataaattccattgatattagtgcgttatattttttgacaggttaataaacgtgatccaccgcacgctttgtcgcccaccaggcggagcgaatgactacccttaaagaaaagccgataattagcgacgaatttcggaggttggatccttatgctcaatcagaaaattcaaaaccctaatccagacgaactgatgatcgaagtcgatctctgctatgagctggacccgtatgaattaaaactggatgagatgatcgaggcagaaccggaacccgagatgattgaagggctgcctgcctctgatgcgctgacgcctgccgatcgctatctcgaactgttcgagcatgttcagtcggcgaaaattttccccgacagtaaaacctttcccgactgcgcacctaaaatggacccgctggatatcttaatccgctaccgtaaagtgcgccgtcatcgtgattttgacttgcgcaagtttgttgaaaaccacttctggctgccggaggtctactccagcgagtatgtatcggacccgcaaaattccctgaaagagcatatcgaccagctgtggccggtgctaacccgcgaaccacaggatcacattccgtggtcttctctgctggcgctgccgcagtcatatattgtcccgggcggccgttttagcgaaacctactattgggattcctatttcaccatgctggggctggcggaaagtggtcgggaagatttgctgaaatgcatggccgataacttcgcctggatgatcgaaaactacggtcacatccccaacggcaaccgcacctattatttgagccgctcgcaaccaccggtttttgcgctgatggtggagttgtttgaagaagatggtgtacgcggtgcgcgccgctatctcgaccaccttaaaatggaatatgccttctggatggacggtgcagaatcgttaatccctaatcaggcctatcgccatgttgtgcggatgccggacggatcgctgctcaaccgttactgggacgatcgcgacacgccgcgtgacgaatcctggcttgaggacgttgaaaccgcgaaacattctggtcgcccgcccaacgaggtgtaccgcgatttacgcgcgggggcggcctccggttgggattactcttcccgttggctgcgtgatactggtcgtctggcgagcattcgtaccacccagttcatccccatcgatctgaatgccttcctgtttaaactggagagcgccatcgccaacatctcggcgctgaaaggcgagaaagagacagaagcactgttccgccagaaagccagtgcccgtcgcgatgcggtaaaccgttacctctgggatgatgaaaacggcatctaccgcgattacgactggcgacgcgaacaactggcgctgttttccgctgccgccattgtgccactctatgtcggtatggcgaaccatgaacaggccgatcgtctggcaaacgccgtgcgcagtcggttactgacacctggcgggattctggcaagcgagtacgaaaccggtgaacagtgggataaacccaacggctgggcaccgttacaatggatggcgattcagggatttaaaatgtacggcgatgaccttctgggtgatgaaatcgcgcgaagctggctgaagacggtgaatcagttctatctggaacagcacaaactgatcgaaaaataccatattgccgatggtgttccccgcgaaggcggcggtggcgagtatccgttgcaggatgggtttggctggactaacggtgtggtacgccgtttaattggtttgtacggcgaaccataatatttttacagccagccgctaacttcctgctggctgtaaaattatcctcttcaggaggagatatttaacatcattgccgcctgggtgcgatttttcacttccagacggcgatacagggattccagatgcgcttttaccgttccggtactgatattcagcgctctgccgatctccttatttgattcgcccgccgctaacatggttaaaatctcccgctggcgggcgcttaacgatttgagatctttaatgtccttttccggcgtcgtccgccagtctccaggcagaaacatcatccccatcgccgcactatttaccgccaacgcaaatgtctcgacggttgaatcacgaggcacaatggccagcacattaaaatggataacttcctgtaaccaccgtttattgcaatccgtcgccgtaattaacaccttaacctcaggaaattgcaccacggttttttgcagcaaccagtagcaaaactcaccatcctgatcgccatcgagcataactaaggcttcagggtaactttccagcttttgccataactcgtctgcctgactggccccctgaatactcactcctggaatacgctgctgtaaactgattttcattccatgaataaatattgactgcctgtcaaacatgactatttgcataactgaatctccacctgaatacgttaaaaagacttaagtagtggaagggtattacccgcgagaaaaaataagaattcgccatttggcggtggccattctacagagatgacgtgtagaaaatagttaccgatataaatagttacagctaaacgcctgaaattacatgtcgagggcactatttaaaacaattttgaggatttccttatattggtggttagtacgcatgcaattaaaaatgaaattccgcgaccacaagccaaaataacaaacggcaaggagacaaaaataagcacaaatagccaacacgtcctctgttcactttaaagggaatcgctgaaaaatacgctctgtttaaggggattcacctttctcagaaagctattccgcccttttcctgctgagaaatcgccacattcggcatgacaacattgtgaaacccggcattagatgttagaaaaaacaataaacaatgcgatatgcgcgttactgtttcgctgtgaacaacaatcggtcaaagaaatggataaaattcacgcaatgcagttgttcatcaaagtcgcggagctggaaagtttttcccgcgcagcggatttctttgctttgccaaagggaagtgtttcgcgccagatacaggcactggaacatcaacttggcacccagcttctccagcgcaccacgcgacgggtcaaactcacgccagaaggcatgacctattatcaacgagcaaaagatgtgttgagtaatctcagcgaactggacggtctgtttcaacaggatgccaccagtatcagcggtaaattacgcatcgacatcccgccaggaatcgcgaaaagcctgttactgccgcgcctgtcggaatttctctatctgcatccgggaattgagctggaactgagtagccatgaccgtccggtagatattcttcatgatggttttgattgcgtgatacgcactggcgcgttaccggaagatggcgttatcgcccgtcccctcggcaaactgaccatggtcaactgtgccagtccgcactatctgacgcgctttggttatccgcaaagccccgatgatctgacttcacacgcaatagtgcgttatacaccgcacctgggtgtacatccgttaggttttgaggttgccagcgttaatggcgtccagtggtttaagtctggcggcatgttgacggtaaacagtagcgaaaactatctcaccgccggtcttgccggtctggggattattcagatcccgcgcattgccgtgcgcgaagccctgcgtgccgggcggcttattgaagtattacctggctaccgtgccgagccgctctccctttcgctggtttatccgcagcgtcgggagctttcccggcgtgtaaacctgtttatgcagtggctggctggcgtaatgaaagagtacctggactgaccgactatactttttaagaatgaccacgacagaaggacaaaagagcggatgacgcaggaaaacgagatcaaacgtcccatccaggatctggagcacgagccgattaagccgttggataatagcgagaaaggcagcaaagttagccaggcgctggaaaccgtcaccaccactgccgaaaaagtccaacgccaaccggttattgcgcacctgattcgcgcgacagaacgctttaacgatcggctgggtaaccagtttggtgcggctatcacctatttctcatttttgtcgatgataccaattttgatggtgtcgtttgccgcagggggctttgtgctggcctcccatccgatgttgctacaggatatcttcgacaaaattctgcaaaacatcagcgatccgacgctagccgccacgttgaaaaacaccatcaacaccgccgttcagcagcgtacgactgtagggcttgtcggcctggcggtggcactttattccggcatcaactggatgggtaacctgcgtgaagcgattcgtgcccagtcgcgcgatgtctgggaacgctcgccgcaagatcaggagaagttctgggtaaaatatctgcgagattttatttcgctgattggtttgttgattgcgctgattgtgacgctttcgatcacctcggttgccggttcggcgcagcaaatgattattagcgccctgcacctgaacagcattgagtggctgaaaccgacgtggcgattgattggcctggcgatttccatcttcgccaactatctgcttttcttctggatcttctggcggttgccgcgccaccgtccgcgcaaaaaagccctgattcgcggaacatttctggctgctattggttttgaagtgattaaaatcgtgatgacctacaccctgccatcgttgatgaaatccccctctggcgcagcatttggttccgtgctggggctgatggcatttttctacttcttcgcccgtttgacgctgttttgcgcggcgtggattgccaccgccgaatataaagacgacccgcgaatgccggggaaaacgcagccttaaaataggccggatgcggcgtaaacgccttatccggcatacgattttattcggcctggctccccgtaggccggataagatgcgccagcatcgcatccggctataatgcgcacataacctcttgaaactcgtccccagagcctcttcagccatctatttgggagcaaacaatttcattccaactcataaccccagcatataaatccagttggtaacttttatttaacctgaaaccagttttatccactatttataaaattatgtgaagcatttcatagaagaaaaatcactggcctaaacattatcccctttttgcctgatttttgaccatttccgcgatttgttacacattgaaatatcacttttgctgtgcgtaatatggctattcgttagccaaaaaataagaaaagattatgcaagcaacagccacaacactcgaccacgagcaagaatacacgccgatcaactcgcgtaataaagtccttgtcgcctctctcattggcacagccattgagttcttcgacttttacatttacgccactgcggccgttattgtgtttccgcatatcttcttcccgcagggcgatcctacggcagcaacgctacagtcgctcgccaccttcgccatcgccttcgtcgcgcgccccattggctctgccgtttttggtcattttggcgatcgcgttgggcgtaaagcgacgctggtcgcctcgttgctaacgatggggatttcgaccgtggtgattggtctgctgccgggctatgccacgattggtattttcgccccgctgctgctggcgctggctcgatttggtcagggtctgggcttaggcggtgaatggggcggcgcggcgctgctggcgactgaaaacgccccaccgcgcaaacgtgcactgtatggctcctttccgcagctgggcgcaccgattggcttcttctttgccaatggcactttcttgctgctttcctggctactgaccgacgagcagtttatgagctggggctggcgtgtgccatttatcttctcggcggtgctggtcattatcggcctgtatgttcgcgtgtcgctgcatgagtcgccggtgtttgagaaagtcgctaaagcgaaaaaacaggtgaagatcccgctgggtacgctgctgaccaaacatgttcgcgtaaccgtactgggtacgttcattatgctggcaacctatacgctgttttacatcatgacggtctactctatgacctttagtaccgccgccgcgccagttgggcttggcctgccgcgtaacgaagtgttgtggatgttgatgatggcagttattggttttggcgtgatggtgccagtcgctggattactggctgatgcctttggtcgccgtaaaagcatggtaatcatcaccacgctgatcatcctgttcgcgctgttcgcctttaacccactgctcggttctggcaacccgattctggtttttgccttcctgctgctggggttaagtctgatgggtctgaccttcgggccaatgggtgcgctgttaccagagctgtttccgacagaagtgcgttacaccggagcatcgttctcttacaacgtagcgtcgattctcggggcttccgttgcgccatatatcgcagcctggttgcagactaactacgggctaggtgcggtggggttatatctggcggcgatggctggcttgacgttaatcgccctgctgctgacccatgagacgcgacatcagtcgttgtaataagagtgaaaagcctgatgcgctacgcttatcaggcctgaatttccatacaatatattgaattcgcaaggatttgtaggccggataaggcgttcacgccgcatccggcatgaacaaagcacactttgccaacaatctaaatctgtttaattgccggatgtcagacatccggcaattatcatcacttcttcatctgcgacaaaatcgtccgacactgattagcctccccttcggaaggtgagatcagtgccagtaacgccgccgccggtgttaccagcgttgccagtgccgcagcaacagcaccacgggcaatcagcggtccggctttcaccccagcctgcggatttttaaacgtcccccgcacatacagcggcgaacgcagtgtgataatccgaattcctttactctccggatcaatagtcaaatccagctgttccgaagcaaaacttgccgtgccggtaacattaatcaacgcgttctcagtatcgaaagcaaaaatctgcgggcgcgccacgccgttggcaatattcagattcgccgccgcgcagttcacccgcacctcatcatcaccaaatatcgcaccgacaatgtagttgccgacattcagcccaacaatctccatcaggttgcggctcaccagcccgtcattcatcaacagtttcaggttgccgttactgttgcctaaaagtgccgccaccgagttaccgctaccgcgtagttccgcgtcaccgttcatttcccccagcgtcttctgcatcagttccacatcgggcatcagttctttcagtttcagtcgacgagcctgaatatctgcccgcccctgcatcggctttttatcgccttccagatgaatattcgccgcaatgctgccgcccgccatgccaaatttcagcggttgcaggcgcaggtcagcatttttgaggatgatatgagtagaaagatcgctaatcggcaggctactgccatgctcaatgcgccgccctttgaagcgaacatcggcatccataacgtcccatttatcggtttcgaagcggtcataaggcagcactttgcccgcaggctgaacgcttttttcgcccttcttctgttcagaccgtttcgacttttctgcccctttcccggaatcaacgccaatcaacggtcccaggtccgccagccgcaattgccgcgactcgacatcaccttccagttttggtcgtggctttccggtggtgtagaccagagaaccgtggatatcgctatcaccaattcgcccattaaaaccgcgataatcaaagaccgacgatttttcagtgtcgattttcgctaccagccgaccatccgtttcaaacggcggggtatcgggcagcagaacgcccgtcagttcatagagatcacccagtgaatcgccagaaaatttaagccgtaaatcgacaccgcccatcttcattgggtcattcacgacgccatcaaaagcaacacgggtgttaccagagcggaaatcagcctgtaccggaaacggcgtcccttcgccacgcagcgccagcataccgcctatttttcccgtacccgtgagcggttcaccgttatatcgtccctgcgccttcaggccaaaaacgtaatcgcccaccttttctttatccgctttacctttcgatccagtaacttcgctgaacggcagcggcttgcctaagggatcaacaaaaatctccagatccgctttgcttactttgtcatcaatggcgatccgcccttgatcgaaaagaatattatccagccgaaacgaccatgccgacggctttgcattcgcgtctttgttatcatcgttggcaagattaaacgtccagttattgttcttttcagagaggcgaatcaggcgcgcgtcgggcttttcgagcttgatccacggcagccagaccgttttggtcagcagcgccagcggggccagcgttgcctctacgcgtggcaaatgcaccatcgtgacttcgggaatatccggtggattgccaagaatgatgtcttccgcgtgtacatggggccacggcacccagctgcgccagccagtttcttgtttttgccgctcccacaccacgcccagatcgccacggatagcgaacggacgattcaactccgcagagactttctggttgatagtcggtttgagtcgattccagtcaaaagttgcaatcaaaatgatcgccacgacaatcaacaacaagaaagcccctgaaatcgcagcggttattttgcctgccttgctcatcgttcgcttcctcatattcttcctgtgccagtcctaaagatagtccagccaggcggaaaatgaggcagcttatagcgccagaaccgccgtattcagcgtttctatcggtgccgggcgtgaaagaaaccagccttgtgcggcgaatgcgggcgagttctgaacatcacgccactcttccggcgtttctacgccctcgacaatcaccccgcgacaatagcgattcattagatgtaaaagctgagaaaagagtgtgcgtccttccggcgactgacgcagcatcacaaacagttctcgcgcgattttgatgtagtcataacgcacttcacttagcgcagagaaatttgccatcccggtaccaaaatcatccagccacagcgggccaaattcacacatcgaggcaaaggttgaatctttcggcagacggatatgctccaccagttcgaaacgcagccagggaagacgctcaatctggcgcaggatttttggttgctgacgcagggcgatgagcgtagggccatcaatattgaccgatgccagcaggccgtgctctataaagaagtcggctttttgcgccagcaaatcaatctgctctttcacaacctccatccgatggctgacggtgatttcagtaaaatagcgatccggcggcaggcgttgcgaagggttcaagggatgcgtgaccaccgttaatagctccacggccattaaccgcccgcatgtttgatagatcggctgccaggtgtaagcacgctcacactgcaaccaaaaacgccgttcctgcaagctctcgatgcttgcttcagggttgcttattcgctggataacctgccttatcatcaaagatgtcctgtgtttaaaagtgatgctgcccggactcgacaaagattatcggcgcgtaagggcagaactttaccgcctggccggggtaaatttcctcactccacaacggaatctttcaggaatacgttctggctcaaaaaaataatggaacactgttttaatatggttgaccagcaaaccaccacagcgcaaactaacgctaattttttacagatcaggttcacgactatgtccaaaaagattgccgtgattggcgaatgcatgattgagctttccgagaaaggcgcggacgttaagcgcggtttcggcggcgataccctgaacacttccgtctatatcgcccgtcaggtcgatcctgcggcattaaccgttcattacgtaacggcgctgggaacggacagttttagccagcagatgctggacgcctggcacggcgagaacgttgatacttccctgacccaacggatggaaaaccgtctgccgggcctttactacattgaaaccgacagcaccggcgagcgtacgttctactactggcggaacgaagccgccgccaaattctggctggagagtgagcagtctgcggcgatttgcgaagagctggcgaatttcgattatctctacctgagcgggattagcctggcgatcttaagcccgaccagccgcgaaaagctgctttccctgctgcgcgaatgccgcgccaacggcggaaaagtgattttcgacaataactatcgtccgcgcctgtgggccagcaaagaagagacacagcaggtgtaccaacaaatgctggaatgcacggatatcgccttcctgacgctggacgacgaagacgcgctgtggggtcaacagccggtggaagacgtcattgcgcgcacccataacgcgggcgtgaaagaagtggtggtgaaacgcggggcggattcttgcctggtgtccattgctggcgaagggttagtggatgttccggcggtgaaactgccgaaagaaaaagtgatcgataccaccgcagctggcgactctttcagtgccggttatctggcggtacgtctgacaggcggcagcgcggaagacgcggcgaaacgtgggcacctgaccgcaagtaccgttattcagtatcgcggcgcgattatcccgcgtgaggcgatgccagcgtaaacgcagcatatgcaaaaggctggataaagtgttacccctctatccagctcatccataaatacctgatggttgtgctaactcatcaccatcaggcattactgtgcaggtggaatatccgtcacttcaggatgtacgtcatccgtggcgacagaggtggtcgcagcggcggtagatggggccatgatttgatcccagaccgcctgcaacgctttcatgttaaattccggctcgcctttcggctgcagcagtattaacgccatatcattcgacaactgttgacgcagatcctgatttaacatctctaccgtcaggctattaaggaaatcctgccgcagtttctgatattgctccggcgcgatatcgacaacctgattttgcaacgaacgcatccgctgacccatcagaatatcggtatcagctcgtgcataggcggcaaacagtttctgcagctccagtttcttttgcgccactaacgcattgaactcttcttccggcagacctttatcgcgaaccttcgccagttcacgcgccaccagattaaggttgctgttcagcttgtcgtttggtgattcgatgttgatggcacactgcgcacgcagatacagcacacggcagtcaaatccaagaccgatgtctttgctgttactggcacttaacgcttgctgaacatgccagaacagcgcctcgcgggccaggtccgcacgccagtagcgcagcagtgcggctgattcacgaatcggctgccacggcgtatcccacatgatagataaccggtcctgacgcaccgcgtcagtcataatactcaccgcttccgcacgcagcggagaaagcgtcggcaccggagctggcgtttcacgtttgcctttcagttcgccaaacgttttgtttatttggtcgacaaccgagcgcgcatccacgtttcccaccaccagtagcgtcattgcatccggggtgtaccatttctgatagaaatctttaattttttccgcttcaacgggttgtttcagcggatcggcaggatcgtgacctaacaaggttgaccctttcagacgatagcgccaccagccctctttagtatcggcaggccaggttgccaccatgtcctgactttgcagcgcgtggttgatggtttctggtgtgatggtcaatttgccagtggcatttgccagataagagagcgcttctttcagcaaatcgttacggttattgggcaaactcagattaaacagcgtggtgtcataagagacaattaccggcggcatcgggcgtttagggtcgatcccctgctgccacaatgaacgcgcctgtgctgcgtcaaggccaccgctttgcgttagcgcaatacgagggatggcgtgactgtaaccgctctgttgtgtactttcggcgagcgaaccggtattaaccagcaggcgaatttcaacacgatcgctgggacgctggggggtggtcagcacttgccactgtaaaccgttggaaagcgtcccctgttgccatgctggatcaggctggagcgcatctgcctgcacatagccagcagtggccatcatcagcaaaccgcccgctaaaagtcgaatttttgtgccctgcatgtgaacccctgatcaactatcctggtaataaaaaaactgcccgttgtcggtcagtctaaatgacgttaaaaacacttcgtgttagaccgcaagaacatgaaaatgtcacggaagaagtgaaataaacctgaactcacccaggtggtaagttcaggcacaggggtcaattatgcgcaaacacccgcactcggggaagggagtgcgggcataagtgatgagattaagaggataattcgtgcgttttgccatccggcgcacgattattcagcacatcgtccagttttttgtggtccagttctttcacccacttagcaacgacaatggtcgctacgccgttaccgaccaggttagtcagcgcacgagcttctgacataaagcggtcgataccgaggatcagcgccagacccgctaccggcaaatggcccaccgcagagagcgtcgccgccagcacgataaagccactacccgttacccctgccgcccctttagaagaaagcagcaacacgattaacagcgtgatttggtggacgatatccatctgactgttagtggcctgggcgataaacaccgccgccattgtcaggtatatcgatgtgccatcaaggttaaacgagtagcctgtcgggatgaccagccccaccaccgatttacggcagccgagtttctccatcttgtcgagcatacgcggcagcgccgactcggaagatgaagtccccagtacaatcagcagttcttcacggatgtagcggataaatttgaagatactgaaaccagtcgctttagcgattgaacccaataccagcaccacaaacaggatacaggtaatgtagaaacagataatcagctgccccagttgcaccagtgtgccgacgccgtatttaccgatggtaaacgccattgccccgaacgcaccaataggtgccagacgcatgatcatattgatgatgccgaagatgacctgcgagaaactttcgatgacgttaaaaatcagttggcctttgctgcccagacggtggagcgcaaaaccaaacagtacggcaaacagcagcacctgcagaatgttaccgctggcaaatgcgccaatgacgctcgccgggatgacatccataatgaaggcgacaatgccctggtctttcgcctgatcggcgtaaaccgctaccgctttcgcatcaagcgttgccggatcgacgttcattccggcaccaggctgcacgacgttaacgatgataagaccaataatcagcgcgatggtactgacaatttcaaagtaaagcagtgcgactgcgccggtacgaccgaccgccttcatgctttccatgcccgcaatgcccgttacgacggtacaaaagatgacaggagcgatgatcatcttaatgagcttaacgaagccgtcgccaagcggtttcatttgctcgcctatttcaggatagaaatggccaaggagaataccaatggctatcgctgtcaggacctgaaagtaaaggcttttaaacagagaggttttcatagggtgtcctttagtaaaaccacaggtcttgtaaggttatggggtacctgcggccttaaaataacacccagacaacatcacagaaatgtacctggatcataattgaaacaaaaaggttaaaaagtttgagctggctcgcacaaaccagcactttttaaagttttgtaatcagtttggggtagctacttttcttccaggtaactctcttcgaagatttcaatagggagtgggcgagcaaaaaggaagccctgggcaataccaacgcccgcttttgccagccagtcgcgttgtgcttcagtctccacgccttcggcaatcatttgtaagttcaggctctgcgccagcatgataattgcagcaatcatgctgctatctcccggcaagccttcaacaaacattttgtcgattttcagtacgtcgattggcaacgatttcatatgctgcagctgacgcagccctgcgtagcccatgccgaaatcatccagcgccacccgaactccggcattgcgcagcggacggaggattgccaccgcagcatgagggtcgtcaatacgtcggctttctgtcacttccagaatcagtgttcccggctgaatgcgatagcgggttaacagttccagcatatccgccaccatattcgggtgcatcagttgcagcgcagagaggtttaccgacaagggcagcataatgccgcgctcttgccaggctgcaagcaatcgacaggactcttccagcacccagtgaccgacggtaaccatcagcccacagcactcaatgcgatcgattaagccatccggcaggtcccaactgccatccggttgctggatacgcagtaacacttccgcactgaccagtttaccgctggtcatctcgacctgtggctgtaaccaaatagcaaactgatgattttccagtgcattaaggatatcgctctcttccgtcaaccgcttctgggcggcttccatctgctgcggatcaaagaactgaatctgattcttgcctttatggcgagcggtaaatgccgcagaaatagcgcgactgtaaagctgttcggcggtgagatcgccgtagaacatcgccacgccaatgctacagtgcggacggagttgaatacgttcaatcggcaggcgctcgctcatgatagtgagcacttgctgacctaaggtgattgcgtgccacggttcctgtacaccgttggcaatgacagcaaagtcataaccgctaatctgcgcgaggatcatacgtggcgacagtaccgatttgagtttttccaccagcgtcagcagcagaatttctcgttgcgcctctttcagcacgcccgcagtatcacgcagggtttcacaggtgatgatcatcagcgcggtggtttgtttacgcgcgacaacctgctccagcatctccatcagcaaggctttgttcggcaaatccgacaccgggaagcgcatcgcattttcgttctgttcttcataatggcgctgcagcaattgctggttgaggttgtaactgcgcaccaacataccgatttcatcgtcctgatgcagacgcggtaatgccagttggtgaccaacaagctccttggctgggatggcgttaagttcgcgagcaatattgcgtaacggatgcaaaatcaggcggttaatgcaccagctgatggcgacggtcaggataagcgacaaaagtaagtaaatggtcactaacgttgagagggtgctcatcacgaacttatacatacggaaggaatccgcctgtagtaccagataggcaattggctgcgggtttgccggacgttcgagcgagtaaacgcccagcgagatttgaaccggtagctcaaacaggcgagtaaccattaccggcaccgggcgctctggaataaaacttttacgcagcgcctggaactggttaggcagcactacatcggcacggctgaccacgcctgccggtttaatgctggcaagaatagcttccgcttcgggaatatcgcctttcaaaatagctgaagataagggttcgcggacagagcgagcaatgctttccagttgcgtagccgtgttatagcgattctgctggaccagatggaacagcaaaacggtgcaaaaaataaaaacgaacaccaggacaacggctgccaccattgccatctgcttgattgttaacgagcgacttacgcgcaaattgtctccccccggaaatcccagattgccgcccgagtatacccgatcgcagcggcattaagagaggcgctatctgaaaacttaccagtcggcgtaaggtatcagcggctgcggcggtaaatccatgtcaccctgccatccggcggcggaataacgtacgtagagcaggaaatggctgggtgcgtaatctttcgcctgctggatatcaattgccgtgccaacaaaccagttggaagtaacacgtcgttcaagtaatgcccgcgccgtgtagccgaagccctgactgctgccgccatcgttggattgccgcgcagcttcttcctgccagtcggtcgggatcagattcatcagcggataacgcggcatggttttggtgcgtgaatgcgaccacgagccagacgcacccagctcccacgaccagttttccgtgcgctcccgccacatcaccggtatggcaaacgacaggtattcctgcggactgtagtaaccgccctgaccgagtgagtagccactcagatctttgtcgtaatgccagatcatgttgttcaggccgattgtgacgcggcgattgttctggttaatgaccttatagtaatagcccgtcatccagcgcacgcgccagttatcttcgacatttttaccggttaactggtcgccactaagcgatgcccagacgccgtttgcttcacctttatcgtagctcagacttagccccacaccgtcggcacgtacgccaccccattttttcccggtattgctcggggagtctttttgcccaccaaaggccagcaaagaactggagatgggccgacggtgggcgttaacggtgtaacccagcggcccgatatcatcgctgtaactgatgccgccgaccacatccaccacgttgaagcccatcggcgtggtaccgatatcccagctccagacgtcatttcgccagccgaccgccacgctggcaccggaatccgactggctgcggttgccgctacagtcctgtaatgtacaggtgccccagttgtcatcccatttgccatcggcattagtggagaaactgccgacgttcatattgacgaaatcactgcgaaagaacatccgcccgtcagaatacggcgcatccacctgcaacatggtagtgtgcgctttcagatcggagtaaccaccggtgccgctcgaaccccagtaatcgtgctcaagggtgacgttaagatcctgctggcgatagaggtccgccgcatcgctgcgcacgccacgtttcagccagtcatctttctcgtcgttacgggtcagtcgggtaaaggtgtcgttatcctgcggacgcgtcgtagtcacaccggatgcgaccatggcgtctttgtaggtttccagcgcctgcgttggatcgcccgcctgcgcttcaaacttcgcaccatcacgcagcaccatcgcgctttccatcgacggtggctgagattttgcctgcgggatcaacttattaaacgtccgctgcgctgctgcggtatcgccaagctgcgcctgtgccagcgccacgcgccgctgtgtgttcagcgaggcgttatcggtagcgggcagtttcgccagctggctacgtgccgccgctttgtcaccggcagcaatatccacttccgtcagaccaagaatggcgtcggcgttagctggctcccgcgtcaggacattctgatatgcagcgcgggcggcggtgtaatcacgtcgttgttgcgcccagtcagccagcgtgaggtcaatacgcgtggaaggtggttgctggcgcagcatcgcttccgcttctgcctctttgccgctttctcgcaggcggttagcggtttccagcacctgatcgctttgcagtcgattaaccagctcctgaatattgctgttccactgcgcacgcggcaggctattgatatgcgccagcgccgctctgtcctggtcatgaccagagaggtacagcccgtaagcgtaaacctgctccgggtcgttcgacttctgctgcgccagattgcgcattaacgtatcggcctggctgcgttgtccggcctgccagagatcctgcgaaagtcggtaagtaatccatacgctgccggggtccagcgccagtcgttgccgctgaagtgctgccgcctgcgcccatttgccctggttttccagtgcctctgcctgctgtgccagacggtcgttttgcaggctgcgttcgatatcatcaatgctacgccgctgactggcagagagcgaggcgataaacgcttcagctttttctggcgattgctggcggtaaatatttgccagcccgcgcacggcgttagtgttgccgctgtccatacgcaaggtctgctgataataacgttcggcggcgggataatcttttcgcgccatcgccacatcgcccagccccagcactgcataactgtcggtgttatcgacattacgcgcctgctggaacaggcgttctgcccggtcaggattattggctttcagcgcagcatcgccctgctggatcgccagccagtagcggtttactttcagcagactgttccatttgtcgttgttgctgctgtgcgggtccagtgcgagggctttttccagattcgccactgcattggcgcgatcgcctttctgagaatacgcctggcccagcgcccccagagcttcactgtctttcgggttcgcccgcaccgcctgttgtagttcgggaatggctttacccgccataccagagtccaccgccgctaaaccttgcgcacgagcgcggaaagcaggatcggccagctgtttttgctgttctgccagttgcgattgcgcagccgccacgctatcgccatcactaaagatcgagagatattttttcagcgccgacacactggcatcactgacgggcatgtctttaatctgcccgtaccagattttagaggccccttcgcgcccggcgttcgattttgccatctgttccaggacggcaaaaccttcgtcacggcgatcgctactaaacagcaatagcgccagattgttttgcaggcccgtattgcccggtgcatccgcattgatgcgttttaactgattaatcgcttcgccacggcgagccggaattttcgccaccgtactccagtactcgacagcaatgtcaccttccggcggcgcaccgttgaacagtttgttgtaactcgccacagcttcttctgcatgaccggtcgtcgcctgcaatcgtgcctgttgcagtgcctgacgaccatccggcgtggaaagtagcatcgtagtccgcgacgatttatacgcatttgaactcggcgctaactgcgacagccgatcgagctgtttttgcgcgccatcaatatcgccctgacgtaacaaagaacggaaacgggcggcaacgacgtccgggttattcggatcaataagttccagccgatataacgactgttgcaccagatcttcacgatgggtcgcttcgcctaaccgaacttgctccagcaactgttgctgagcggttggtgctgcctcgaccatcggcatgacggccagaccgagggaaagcgtgaatatgtttagtgtgaatttgcgcattcctggccccagtcaggtaataactcaccttttgtcgagaagcggaaacggtgttgatcccagccttgtccaaacagggtcagcacatagttgtaataggcatcgctgccgggaaagttatcggccacgcgctggcgctgaacggcctgcgcatcgcggttttgtaaaaagggcagcatggcggcagaaaaaccgactggtcctttaccctgcgctttccccgtagccacatccactttttccggcggataaccgtttttctcagtgaatgtcgccatcggtttaaaccggttgagcatccgcgctttttgcggatcgctgtcaggcatcatgcctacccacatgtaaacgcggatagcgtcgtagctgctgatcaatgttttttcggcttttagctgccagcctttgtctttctcatagcgcacccagtctggcgaaaaacctttcggggcggtttccagcaataaacgttgattggtttcgcgcagcgtggtccacggcgcgccaaagcgggtgaaatactgcgccagcgtcggcggcaggtagctggggttaaaacgccagctgttatcctcagcaaaacccactttgcccggtaacaacatggaacccagcccaggcaccgtcaccacttcctcccgcgcgatacgttttagcaacgcgctgccgatgtcggtataacgctgctctttccacaaacgccccgcctccagcaacgaccaggccatccagacatcaccatcggaggccgaattgctgtccagcacttcccacttactgttctctttcttgccccacagccaggcgggcaaacgttcttttaaagaaccctgagcgagattgttctgcgtccagtcgagaatattatcgaaagctgcacggtcgttagccgccagggcagagaacatgccgtaactttgcccttcggaggtggtgattttgcgcgcgtcgctggggtcgatgacgcgcccttcctgactgatgtaatcctttttaaactgctcccaggcaggccaggtacaggctgcctgaacactaaaggcagccagcagcagcatcgtcacgattccactacgcaacacattcatcttcaattactcgttatccgggttaagacgacgacgactaataattcgcagcagacgccacagtacccatgccagcaatatcacactgatagccgccagcaccgccagcagaatcggatggtttgccagcgcataccacacgcgctcgaaccacggcagatgacctacgtaataaacgtcgccaacacgtaggctgttgataccggactcgcggatcaccgcgaccgaaccgaacatggtggcgcgtttgccgctatcgttcaccgcatcgttaagcatttcataaccgcgtgggctatctgccaacagcgcaatcacgctgcgctggtcgttatacggcgactggaagccaatcaccgccgccatcgcaccggaagaggtcagcgttgaccgggtttctgccgcgcgatcgctctcgtccggcacaatgccggggaacggggtctggcgcatcggtgttttcacccagctttcggtcgcctgcaccaataggtcgatctgcttatcgtctttcagtttgtccgggataccaccgatgatcatgatgtcggcatctttgccctgaatggtgctgccatcatcggtcaccgtcagattaatcgccgggaagcccgtctgtgcgccgataaaaccaacagtattcagcaacgtttccatctgtgcttcgttaggcgctttcggcatcacggtgatggtttgcgacagatccgccatccggctgaatgggaagcccgcgttagcaaaggcgcgtagatccggcatcgggatgaagtggtaatacttcgagaagtcgatggtggagtcgtcaccaatcaccacatgattctgcaccggctggaaggtaatacagttatccaccgaaccgcccggcatcgggttcatatactcaaagtcgaagcgcagctggttggtcgcgcccagtttcagcgccggaatagagacatctgttttgccatccagcaaaccttgtaataccggaatccgcagcagcaggcggttcgcctcctgtttgctgctcaggttgaaggattgcaggaactggttattcaggctgatatccatccgcgaactgtctttcaccggcggcatggtgtagcggtaattaatatccatatcaatgccggtactgcgcatcaggtagagatccggcggcaggtttagcgaaacgttaatcgctgctggctcaagaccgctggattgtaactgttcttcataggttttcagttcgccaaatgtgaccggacgatcggtacgtacccagttcggcgcatcgtacggcttacgcggtagcagcggtttcacttcattcactaccacgctttcaccacggaacagaatgttaccctgagcgatacctttcgctgcctgcaacaggtctttgtcgtcacgaccaaacaccaccagcagtttgacgtaaggattctgcggatggttaatcatctcaatcaccggggcttttaccgccggatgatcgcgcaggaagtccggccgtttgtcgttggttgcaaagacaatggcattgcgatccggcagttggttatagagtaccgggaagttctgcccacgccagccagaacgcgaaccaaaccacgaggcgacaatggcagaggcttgttgcagcccaacatccggcgcacccgcaaagaccatcggcaaggtgttggtgcggttatcgctcgggtcaaagaatggcaccgggaagtgtgacaggtcattcttcacattcagggtctgataggtcagatccagtccactgctccgcccaacatccagccaaagcgtggtgctggccggtttttcgcacacgtcctgataatggccgacaaactccagccgtacacggttgaagtcgctaataaacagtgggttaatgggcatttgcgccagcgtttttttacccaactgttctttggtcactggcagcacgcccatcagttcatcattgagataaacctttaactgcgactggacaggcagtaacgatggcgatggggtgtattcgaggttgagcatcgccttcgtcaccacttcatcgctgcgcataccaaactcaatgctgccgttcgggttaatgccacgtagcaccatgctgcccggcggcggtgcaatttgcgcaaaggtcagcttcacatcacgcgaaggaccgttctgcgccacgactggcgcatcagcgccctgcacgcccggcatcacttgccccacctgcggattttgttccgtctgggcggctacagctggctcagcattgatcagtggttgcgttgctggcgtcgcctgcgtcatgaaagaggggaacgcactcatccccatagccactgcacaaatccagaatagttttcttttcatcgcgttatcatcattgttgagccaaagcctgatccgatggttgtgccgtttcgctccgctccgggcggcgcggaataaacgatacaacccaggaaaccagagaagtcagcacacggaatatgcccttcaccgaagaaggcgcaaactccgccagatggcggtagccacggaagccgagcttcagaatatccagcagactttccagcggcttatcttccgggtagctgtcctgccagagcgcccatgtatccgcacgggcaaacgtacactgcacaaaatcgatatgttgctgggtggtgagcggcattaatttcagcccaacttcattacccatcacgcgcgccacctgggtcgggaagacgtattcctgctgaccgcgtttaagcaacagattcactttctgcccttccagaatctgcgcctgaccgttgatcttgatccccaaaccaccgtcggagaaatcctgaacggtacacgagaagaggtgaccatcttcgcgggcaattgccgcgggcatcgtcatctccacgcggtgcgatcggcgtacctgtttgctttctaccgataccgcaactgcgccgccaagaacaatcaggttgtagaacacccacaccatactgacgaccacggtgagcatctcggttggcgggccatagaagtagcgccagatgcctaccgcaacgcccaccaggttgagcaggacaaggaagatgtagggccgcgagatcacccagtcgacgtactcttcttccaccagtccacctttggcggtgacgttaaatttgcctttgtgcgggttaatcagcgccaccagcgtcggtggtgcgatataccacgccagcaccgtttcgtagatttcactccagaaagagtggcgatatttgccctggatcttggagttggtcaggctggcatggatcatatgcggcagcacgaatagggcgatcatcaacgctggcgcatagatgatgtaggcatgaagcagcaggaacgccagcggcgcagtcaggaagatcagccgtggaatgcccgacaagaagtggaacatggcgttgacgtaacatagccgctgagcaaacttcagccctttaccggtgagcgggttatcgagacggaagatttgtaccatcccgcgcgcccagcgaatacgctgaccgatatgcgccgacagactttcggtcgccagccccgccgcctgcggaatacgcatatacgcggaggtatagccacgacggtgcaaccgcagagaagtatgcgcatcttcagtcacggtttcgacagcaatgccgccaatttcatccagcggcttacgacgaatcaccgcacaggaaccgcagaagaaagtggcgtcccacatatcgttgccatcctgcaccagaccatagaacagcgtgccttcgttcggcgttttacggaaacgccccaggttgcgttcaaacgggtccggtgagaagaagtggtgcggcgtctgcatcatcgccagctgtttttctttcaggaaccagcccatggtcatttgcaagaacgatcgcgttggtacgtggtcgcagtcgaaaatcgacacgaactcgcctttggcatatttcagcgcattgttgatgttgcctgctttcgcatgttcatgagtggtgcgggcgatatatttcacccccacgttttgcgcaaactggcgaaactcttccctgccgccgtcatcaaggatccagatattcagcttatctttcggccagtcgatacccagcgaggcgtaaatggtatttttcaccacgttgagatcttcgttgtaagtcgggacaaagatatccaccgacggccacagcgacatatctttcggcaatggcaccggctgacgattcagcggccatactacctggaagtagccgagcaccagcacaatccacgcgtacgtttcagcgaagagcagaataagcccgcacaccaggctgaccggatcgtcccagttcagcgtagaggtgtaacgccaccagatataacggcaagaaacggtcagcgacagcacaatcaacattagcgccgagaagcgccccggcatccgccgtacgatcagcgctaccccccacagcagcatcaggaagataaactgcgccagcgggttaaacggctgagtaacgcagattaacgccagaatcagcgagaaggtgacgatgataccgaggatcaaccgccgcgccccggcactcaaatgaccgagctcttttttctcatccagatgctgtgttttatggctaacgcgctcaggcagctcgttcatccattgatggtaacgtccacgaatattttgcagacctgaaaatgcccgcctgcgcggtttcggcgtttctttgcgcgatgcaccgatcaataaccagcatgtttgaatgagataacggaccgggtccagcggacgcggacgcgaggcgttgatatgcggatacaggtttttatgttctgcgcgaatacgctgccagcgcgggtgctccagcggaataaaaatccaggccaggatcatccagaaacagccgagcgtcgcgctgaaagccgacgcaccgtgacgacgataatcgcgataacgcccgataagccgcgcgttgaccggcgggataagcaaccaccgggtcaggatactcatgatgcactcccgactggcgttttcagcccggagtagttcaacaggcaccagttcgccagcgtcagtatctcttcagccgccagcgcatcactgcgatattcacctactggttgcttagccgccaggcattcagccatcgcttcatcacgatgaatgagcatcggcagtaatcggcgctggctttgcaaccaaagctggtaaatatcgtcctgaacctgactgccaatacggaagtcattaatcaaaatatgtgcgccatccggcagcgcttgctgatgcagtcggatatggcagttggcatccacattgacgattgccagcgagtgatcgcacaaactcagcagctggtgggttatctgcgaggcatcacgcggtaagtcgattaaaatccactggtaacgcccgctggcttttagttgctgtaagccggagcaaatatcgctcagccgggtttgccagtgctgtggattttcttgttcttcaatggataactgaccaaaaggcagcaaatcgagctgcgaggtgtagcgcaacccagcgtcacgccagtcctggccatccagcatcgctctggcccagccctgacggtgggtaaaatcaacattaaatgacaggcgcaacaagttgtccgggcaggcatcgaccaccaggacattttctcccaacatttgtaatgaccaggctaatgcggcggtgatggttgttgtccccacgcctccccgcaccccctgctatcccagtacggccattcaccaatcccctacttttgttgcgcaaactctgccagcaacggccagcgttttaatgccgcggccaactgttcgcgttgggaaatatcggcataatcaatatcaggcagtgaaaatgcctgctttaacgccacaatatcattctggaagatatagcctatcgcgggatcaggcagagtatctggttcattgttattcattttgcttgatccctatgaaataaccgtaccgttcatgagacaattctaaccgtgagcatttcgccggtttattgtttacggcgagacgggaatttgctcactttttgactttccgttacgcaacagaaaaagttaaaaacgaaaagactaaaatcacacgtcttgtgaccttctaaattgattcacatgctaaatctgataagttttaatttcaatggtaggtttatttcttagctttcgctagtaaactgataatcagacaaaatggtgacatgagggacattgtggaccctgtattctctatcggtatctcatcattatgggatgagctgcgacatatgccagcaggcggcgtctggtggtttaacgtcgatcgccatgaagatgctatcagtctggcgaatcaaacaattgcatcccaggctgaaaccgcacacgtcgcggtcattagcatggacagcgatccggcgaaaatctttcaattagatgattctcaagggccggaaaaaataaaattattttcaatgctaaatcatgaaaaaggtctatactatttgacccgtgatttgcagtgttctattgatccccataattacctttttattcttgtttgcgcaaataacgcatggcaaaacattcctgccgagcggcttcgctcatggttggataaaatgaataaatggagcaggttaaaccattgttcgcttttggtaattaatcccggaaataataacgataaacaattttcattgttgcttgaggaataccgttcactttttggtcttgccagtttgcgttttcagggtgaccaacatttgctggatattgccttctggtgcaacgaaaaaggggtcagcgcccgtcagcagcttagcgttcagcaacaaaatggtatctggacattagttcaaagcgaagaggcggagatccaaccacgcagcgacgaaaaacgcattctgagtaatgttgctgtactggaaggtgcgccgccgctatcggaacactggcaactgttcaacaataacgaagtcctgttcaatgaagcccgtaccgctcaggcggcgacggtggtcttttctttacagcaaaatgcgcaaatcgagccactggcccgcagcattcataccctgcgtcgccagcgcggtagtgcgatgaaaatcctcgtgcgggaaaataccgctagcctgcgcgccaccgatgaacgtttgttattggcctgcggtgcaaatatggttattccgtggaatgcgccactctcccgttgtctgacgatgatcgaaagcgtgcaagggcagaagtttagtcgctatgtgccggaagatatcactaccttgctgtcaatgacccagccgctcaaactgcgtggtttccagaagtgggatgtgttctgtaatgccgtcaacaacatgatgaataaccctctattacctgcccacggtaaaggcgttctggttgccctacgtccggtaccgggtatccgcgttgaacaagccctgacgctgtgtcgccctaaccgtaccggcgatatcatgaccattggcggtaatcggctggtgctgtttctctcattctgtcggattaacgatctggataccgcgttgaatcatattttcccattgcctactggcgacattttctcaaaccgtatggtctggtttgaagatgatcaaatcagtgccgagctggtgcagatgcgcttgcttgccccagaacaatggggcatgccgctgcctttaacgcaaagttctaaaccggtcatcaatgccgagcacgatggtcgccactggcgacgaataccagaacccatgcgactgttagatgatgctgtggagcgctcatcatgatgaccatcagcgatatcattgaaattattgtcgtttgcgcactgatatttttcccgctgggctatctggcgcggcactctttgcgacgcattcgcgacaccttacgtttgttctttgctaaacctcgttatgttaaaccggccgggacgttacgccgcacggaaaaagccagggcaaccaaaaaatgactcaatttacgcaaaataccgccatgccttcttccctctggcaatactggcgcggcctttccggctggaacttctattttctggttaagttcggcctgttgtgggcgggatatcttaacttccatccgctcctcaatttggtgtttgccgcgtttctgctgatgccccttccgcgctacagcctgcatcgcttgcgccactggattgccctgccgatcggctttgctttgttctggcatgacacctggttgcctggcccggaaagcataatgagccagggttcgcaggtggcggggttcagtaccgattatttaatcgaccttgtcacacgctttattaactggcagatgattggggccatttttgttttattagtggcctggttattcctgtcacaatggattcgcattaccgtttttgtggttgccatactgctatggctgaacgtacttaccctggcgggaccaagtttctccttgtggccagccggacaaccgacgaccactgtaacaacgacgggtggtaacgcagcggcaaccgttgcggcgacgggtggcgcaccggtagtgggtgatatgcccgcacaaactgcaccgccaacaacggcgaaccttaacgcctggctgaataatttctataacgcggaggcgaaacgtaaatcgaccttcccgtcttcgctgcccgctgatgctcagccatttgaactactggtgattaacatctgttcgctttcctggtcggatatagaagccgccgggttgatgtcgcatccactgtggtcgcatttcgatattgagttcaagaactttaactccgccacctcctacagtggcccggcggcgatccgtttactgcgcgccagctgcgggcagacttcgcacactaatctgtatcaaccggcaaataacgactgctatctgtttgataacctttcgaaactgggctttacccagcacctgatgatgggacataacggccagttcggcggttttttgaaagaagttcgcgaaaatggcggcatgcagagcgaattgatggatcaaacaaatctgccggttattttgctgggctttgatggttcgccggtttatgacgataccgctgtgcttaaccgctggctggacgttaccgaaaaagataaaaacagccgtagtgccacgttctacaacacgcttccactgcatgacggcaaccattatccgggggtcagcaaaacagcggattacaaagcgcgggcgcagaaattctttgatgaactggacgccttctttactgaacttgagaaatcgggtcgtaaagtgatggtggtcgtggtgccggaacacggcggcgcgctgaagggcgacagaatgcaggtatctggcctacgtgatatccctagcccgtctatcaccgacgtccccgttggggtgaaattcttcggcatgaaggcaccgcatcagggggcaccgattgtcatcgaacaaccgagcagcttcctggctatctccgatctggtggttcgcgttctcgatggcaagattttcaccgaagacaatgttgactggaaaaaactcaccagtgggttgccacaaacagcaccggtctccgagaactcaaatgcagtagttattcaataccaggataaaccgtacgttcgcctgaacggcggcgactgggtgccttacccgcagtaagaacgaaaaaggccgcagagtttcccccctgcggcctggtccgggcgcaaattgccattacggcagcctgacgcccgcatgacacgttacttccgcttgttcagccagttcacgatcatactggcaagaatgccagcaatgaccggagccgctaaatcatgccagaaggccatgcccagctctgcgaacgtcatatagccgcctgtgttgtaatgacaacgtttcgcggctattcttgagtggtctagagtcaagattagcccccgtggtgttgtcaggtgcatacctgcaacgtgcgggggttttctctctccagcaaccaatgccaccagggataaagcccccgcaacattgcgcctcaccggaacctttccggcttgccgctgattctacgattgctttttactgtcagcacccggcaatcttcctcattgcgcgatgccttccagcttaatttctttatttgcaatagttgcagttcatatccgggctgactccagactggtagtgaaatgcgcaattttgtagaattgcgcctcctcgcgacctccccagtgaatctgttgcctcattttttacatactgcgtattcgacttctccacctgttgcgcaagagaaactgggtttattcatttttgcgaggccgacttctttctggacaggactttatgcagcacaacacactatcgaaacacaatcagaaattgccgtttacacgctacgacttcggctgggttttattatgcataggcatggcgattggtgccggaaccgtgctgatgccagtacaaattggcttgaagggaatttgggtatttattaccgcagcgatcattgcttatcctgccacctgggtagtgcaggacatttatttaaaaaccctttctgaaagcgattcctgtaatgactacaccgatattatcagtcattacctggggaagaactggggaattttcctcggggttatctactttttgatgattatccacgggatttttatctactctctctccgtggttttcgacagcgcctcgtacctgaaaaccttcggtttaaccgatgccgatctttcacaatctctactttataaagtcgctattttcgccgtactggtggcgattgcgtctggtggtgaacgattactgtttaagatttccgggccaatggtggtggtcaaagtagggattattgtcgtgttcggttttgcgatgatcccgcactggaatttcgccaatataaccgccttcccgcaagcctccgtctttttccgcgatgtcttgcttaccattccattttgcttcttttctgcagtatttattcaggtacttaacccaatgaatattgcctatcgtaaacgggaagcggataaagtactggcaacccggctcgcgctgcgtacccaccgaattagttatatcacgctcatcgcggtgatcctgttttttgccttttcgtttaccttctcaattagccacgaagaagccgtttctgcctttgaacaaaatatctcagcactggcgctggccgcgcaggtgatccctgggcatatcattcatatcacctctacggtgcttaatatctttgccgtactgaccgcattctttggcatttatctcggtttccacgaggccattaaaggcattattctcaatctgttaagccgaattattgataccaagaaaattaactcacgcgtgctgactctggcgatctgcgcttttatcgtcattacgttgacgatttgggtttcgtttcgtgtatcggtgctggtgttctttcagttgggaagcccgttatatggtattgtgtcgtgcctcattccgtttttcctgatctataaagtcgcacaactggaaaaacttcgcggatttaaagcctggctgattctgctgtacggcattttgctatgcttgtcgccactgttgaagctgattgagtaaaccggagcgcatggccccggttttgtgagttaacgctgcggattttcatcctgatcaacagcaaaacaagctaccagttgaccgccgtagtcttttagctgcggctgcaactgggtgcaggggccgaagcgccgacgacagcgggcgttgaaggcgcaacccggcggtggattcagtgggcttggtagttcaccgctgagcttgatgcgctcgcggcgatcgtccgggttcaggcgcggcgtcgcggaaagtagcgcctgagtgtacggatggcgcgggttattgaagatttggtctttcgttcccttctccacgcagcggcccaggtacatcaccatcacttcatcagcaatgtgctccaccaccgacaggtcgtgggagataaagacataagacagccccaactcctgctgcaaatccatcatcagattcagcacctgcgcgcgcactgaaacatccagcgcggaaaccggttcatcggcaatcaccacatccgggtcgagcatcagaccacgggcgatggcgatacgctgacgctgaccgccggagaacatatgcggatagcggtcatagtgctcggttttcaggccgactttcgccatcatcgacagggctttttcccgacgctgttctttgcttaagctggtgttgatcagcagcggctcttcaagaatttgcccgacttttttacgcggattcagcgaaccgtaagggttctggaagacgatctggattttctgccgacgcagcttctgcgcctgcggatcgtgcttaagcagatcctgcccctggtaatacagctcgccaccggtgggcatttcaatcatcgtcagcaaccgaccgagggtcgatttaccgcagccagattcgcccactactgccagcgttttgccacgttcaaggttaaacgaaacgccatccagcgctttaaccagacgttccggcgcgaacatgcctttcttcaccggataatgttttttcaggtcgatagcctgcaacagcggttgttgcagggtggcctcttgcgtactcatagtgtcggcctcccggcatcatcaagtgggtaatggcatttggactgacgcccgtcagcgagcatattcagcgccggttcttcagcgcgacatctgtcagtggcataggggcagcgcgggttaagcaggcagccgttcgggcggtcgtacttgccgggaacgacacctggcaacgacgccagacgttctttgtcctgagcaaattctggcagcgcacgcagcaatgcctgagtatacgggtgacgcggcgcatggaagatggcgtgcgcatcaccggtttccaccacctggcctgcatacatcacgatgattttatgtgccgcttccgccaccagcgccaggtcatgggtaattaacaccagcgccatgttctctttctgctgtagctccagcagtagttcgatgatttgcgcctgaatggtcacgtccagcgcggtggtcggttcatcggcaatcagcagttttggccgacaggcaatcgccatggcgatcatcacgcgctggctcatgccgccggaaagctgatgcgggtaaacatccagacgcgatgccggatcgggaataccgacctgattcagcaggtcaatcgctcgctgacggcgggtacttttgttgccgccctgatgcaccttaatcgcttccataatctggaaacccacggtgtagcacgggttaaggctggtcatcgggtcctggaagatcatcgccacttcggcacccaccaggttgcggcgctctttttctgagatacgctgcaaatcctggccgttaaactccagtttttctgccattacgcggcccggataatcaatcagccccataatcgccagtgaactgaccgacttaccggagccggactcacccacaatcccgaccacttcgccctgttttacgctgtagctgatgcggtctacggcgcggaacggcgcgctttcgtcgccgaaatgcaccgataatttatctacatttaataacgccatctcgaacctcttactgcttcagtttgggatcgagcgcgtcacgcagaccgtcacccatcaggttaaatgccagcaccgtcagcaggatcgccagacccgggaaggtcacgacccaccaggcgctttgcgcgaactgcaacacgtcggagagcatggtgccccactcaggcgttggcggctgtgcccccatgccgaggaaaccaagagcagccatatcgagaatggcgttagagaaaccgagcgacgcctgaacaatcagcggcgcaaggcagttcgggaagatgttaataaacatctgacgcatcgccccggcacccgccacgcgagacgcggtgacgtaatcgcggttaacttccaccagcacggcggcgcgggttaagcgcacatagtgcggcaaggcaacgaaggtcagtgccagcgcggcgttaccaatcgacgggccgaaaattgccaccagcaccagcgccagcagcagacttggcagcgccagcatgatatcgaccacgcgcataatgatgttatcgaccaggccgccaaagtaaccggcgatcaggccgagaataacgcccataatcagcgataacacaactaccagacagccaaccagcagcgacaggcgcgcaccgtacatcaggcgcgacagcacatcacggcctacgtcatcggtgcccagcaagtgcgccatgctgccgccttcctgccaggctggcggggcgagcagtgcatcgcggaactgttccgccgggttatagggtgcaatccagttggcaaagatcgcgatgaacagcacgatgacgacgtaaaccagcccgacgaccgcgcctttgttgcgtttaaaatagtgccagaactcctgtaacggggtcatcggcaccggtgcgctaatcactttattttcagtaacctgtgacatgatgtccccttacttcttatgacgaatacgcgggttcaccacgccgtacagcagatcgaccagcaagttgacgaggataatcatcgtcgccaccagcaatacgccgccctgcactaccggatagtcgcggcgttgcagtgcgtcaatcaaccagcgtcccagaccgggccacgagaagatggtttcggtcagaatcgcccccgccagcaatgttcccacctgcaggccgataacggtcaccaccggcagcatcgcgttacgcagcgcatggacgataatcacccgcatgcgggttagccctttggcgcgcgcggtgcggatgtaatcctcgcccagcacttccagcatcgaggagcgtgtcatacgcacaatgaccgccagcggaatagtacccagcacaatggcaggcaagatcatatgggcgacggcatcgataaagttgccgtcttcaccccagatggcggtgtcgattagcataaaaccggttaacggattggagtcatcgaggaacaccatatcgctcacgcgaccggagacgggcgtcaggttccagtgcaccgaaaccagcatgatcagcatcatgccccaccagaagataggcattgaataacctgtcagcgccaggccaaccgctgtgtgatcgaaaatggaaccgcgtttaaccgcagccagcacgccgaccggaataccgactgccgtagcaaaaatcatcgcgcagacgccaagttccagcgtggcctggaagcgcggcacgaactcttcccaaaccgggatgcggcttttcattgaaatgcctagatcgccatgcataacgccccaaatgtaatggagatactgctgccacatcggtttatctaagccgagttcagccagcagctgcgcgtgacgctctggggagatcccacgttcgcccgccatgatcatcaccggatcgcccgggatcatgtggacaaaggcaaatgtgagaagggtaataccgataaacgtggggatgacgagtcccaaacgtcggagaataaactgcaacataacccggattctctatagtgacccgcagcctggaactgcgtgtctgtattgctcacaaatcaattcccgcccttatcggacagggaatgaagtattgctgccggatggcgctgcacgcagaggcacagcgccaccgggtatacagattgttgacaaagtgcgctttgtttatgccggatgcggcgttaacgccttatccggcctacaaaatcgtgcaaattcaatacattgcagaattttcgtaggcctgataagcggagcgcatcaggcatttttgcctttgccatcagtcttgtatggcttttaattattcgatagagacgttttcgaagtgatgtttgcctaatggatcaaccacatagcctttaacttctttacgtaccggttcaaacacggtggagtgagcgatgatcagtgccggagcctgatcgtgcatcaccacctgcgcttgtttgtacagttcaacgcgtttattgtggtcgtcggtagcacgcgccggttgaatcagatcttcaaacggtttgtagcaccattttgagtagttggagccttgttcagaggcggcgcagctgaacagggtggcgaagaagttatccggatccccgttatcgccagtccagcccatcattaccgtctggtgctcgccatctttcgcacgcttgaggtactcaccccattcgtaggtgacaattttggcctgcacgccgactttcgcccagtctgcctgaatcatctccgccatgcggcgagcgttcgggttatacggacgttgtaccggcatcgcccacaggtcgatggagaaacctttttccagacccgcttctttcagcaaggctttcgctttttcaggatcgtaggtgtagtcctgaacgtcgtcgttatagccccacatggttggcgggatcaggtttttcgctgatacgcccgcgccctgataaaccgctttgatgatcgcgtctttgttcaccgcgtaggtcagagcctggcgaactttcacgtcatcgagtggttttttctgcacgttatacgagagataaccgacgttcagccccggcatttccatcagattgatggatttatcctgcttcatgcgagcgatatctgccgggttcgggtacggcatcacctggcattcattcttctgcaatttcgcgtaacgcacggaagcgtcaggggtaatagagaaaaccagcgtatcgatctgcggtttggtgccccagtagccatcaaacgctttgtagcggatacgggaatctttttgatactgctgtaactggaacggaccggttccgattgggttgaggtccagtttttccggtgtaccggctttcatcatcgcatcagcatattcttttgacagaatagaggcgaagtccattgccaggtcagcgaggaacggcgcttccgggcgagtcagcacaaactgaacggtgttgtcgtccacctttttcacttcactgatcagctctggcaagcccatgccttcgaagtattcgtagctgccgccagaaactttatggtacgggttttgcgcgtttttctgacgatcgaacgagaacaccacatcatcggcgttcagttcacgcgtcggtttgaattctttattgtcgtgccacttcacacctttacgcagatggaaggtataggttttaccgtcttcgctgacttcccacttttcagcgaggcccgggatcacttcggtggtgccgattttaaattcaaccagacggttataaagcgggacggaagaggcgtcataggtggtgccggaggtaaacagctgcgggttaaacccttccggagatccttctgagcaataaaccagagttttagcctgaacacttgctgcgacggtcatagccaccaggctgagaccaagcttcagcatccctgactttttcaaggaaatacgcattattctgctccaattgtgatgtttgttgttttaaccctttgcagtgggttgtcgctgcctgaccttttttgttttttgcccggtcgggtcaacgttatgaggtggggatgccgtactaattaacatcagtgtaacagtgcggatcctccataaaatgcccctcgtgacctacaatctgtcaacagaatgtgaaaacgtcaatacagccaaccgggatttacaccaacggtgagaatccacacacaaagattaaaaaaacttcaaacagctatttgcagcagagaaatttgtgctactccaacatgaccagaacaatcagcttaatatttagcaacatttggtgattaagttttatgcatttaatgaaaaaaatctgaggaaaaggtggatatctgagcgattaataccatgaacgctaaaacgcacagcggaaaatgccagggccagccataagtaacgcaaaaaaagatttaagcaaatataaaaaaagacaatggtttctgtcacaaatccgttaatggatagtgagatatggggcgcaaatttggcagggaaatgtgtgtcgtgtaggtcgaataaggcggtcgcgccgcatccgacaatggccggcacatttgcctgatgcgacgctgacgcgtcttatcaggcctacgtcgagtcgaacctccctgcccccggaggttctcatcctcatgagctgcagatgcaaaaaagcctgctcgttgagcaggcttttcgaatttggtcggtgatagaggattactcgccacttcgtggctcgccctgcgggccgttgctggcgcaacgttctctcgcttcgctcgagtcgaacctccctgcccccggaggttctcatcctcatgagctgcagatgcaaaaaagcctgctcgttgagcaggcttttcgaatttggtcggtgatagaggattcgaacctccgaccccttcgtcccgaacgaagtgcgctaccaggctgcgccaatcaccgaatgcggggcgcatcttactgcgcagatacgccctcgtcaatcccttaatagcaaaatgccttttgatcggcgagaaagtcagcaggccgcttagttagccgctgcctcttttgcctgcgggatgtgacaccagttgttgttttcgttaattccaccatccggtgaagtatagccaagacaacccatgatggtatcgtacagctctacgtgacggcgtggcactttcatgtcggcttcttttttcagctgcgcaaacgcctgcgcattggccggattttccagatatttatctgacatccagaccatcatcggtacgcggaactgctccggcggtgccagttcacgcggcgtgccgtgcaggtgctcgcgttcattaattgactcaccgtggtcagctgcgtagaacacaatcgctttcttatcgcgaacctgatcaatcacgctggagataaagtgatccacataggtcaccgagttgtcataggagttgatcatctgcgctttggtacagccgctatcaacaccaatacattccggcttccactgcgcgaagctacgcggataacgctgggtgtagttaaaatgcgaacctttggtatgcagaatgatcagatgcttaccatccgggttgcgccctagcgattgctgcatttcgtctaccagcaacatatcatctaccggcttgccacgattacgtggctccgcaccaatctgctcacgataagcaatgttgtccgccatcgtgttgctgtagaaccacatttcgctctgcatagcgtagaggtcagaactgaatcctaactgcttcagaaccgcgaaaatgttctgttcttttaatgtgcgctgcggattatcttccgcgcccccctgacgtacaaacatgcaacgcagtgagagtttggttgcggtatcacaggagtaaccacggaacgccgccagatttttctcctgggccagtttcggcgtggtattacgctcatagccgaaaatacccatatggtcccaacgcgtggtttcaccgatgataaacacgacataagtgtcatcaacgttttgcggtgcctgataagtgaatttcttcgccggattaagcaatgaattattatcggaagattcatcgacccgcgcccaggcatacagccccaacgcagaaagccagtttgatggcagataagagttcgctacgacaccgccataactcggcaaatcaacgccggtcgccctctccactttcttctgctggatatccagcaaacgaatcggtgcccaaaccataatacccgccagtacgacgaccgccaggctgcgaatacgctgccctggggttcgcagttgtcggagcaaggtgtagcgacagcggttattccagataaggataagaggcaatgcactaacggcgattaaccagagaataaagttcagaccaacaacttcttttgacaggtcgatatcggtggtcatgacggaagcgatgatgccataaccaatgaccacattaaggaaggtcatgtaatagctggcacctgcggaaaagagcaccaccagcgatgccagaatacgccagctgcggcggccaaacagcgaaagaagacgtagtaaaaagaaggtcaccagtacggtggcggccagttcaacaacagcagaaatgcctttccagacggtaaaatcgtgcgcatagctgccgaagcggcggtaaaaaaccgcgccattcataaaaaggccaatatagattgcaagcaaaaagctcagcttctgctgtgtaatcgatttgatgtatctcatgcaaacaaaccctggacaaacaggtgataacaccctgcttagtggcttttcaggcccggcagggaaaaagtgcggaggtagtcagataagtaaaatctacacgcgcgaataagtagaccacagcaaagggaaaaagtgtggggaaagagtgtgcatgaagcacaaatttacaaaaatgcaagtttgaaaagagactttagcgttacaaaaagcagtaaaaagggccagttaattggcccaaattttacgagtcattgtttatacatttcgttgatgcgtttgatgcacacggaagctgaagcccagtagctcgcggctgagcattaaagggagccatgcgcctcacgcaacattttctgctctggctgacgaatcgtcgtagaaagcgccaatgacagaatcagcagggcgaaaatcacgtagaaggtcacatagaagccgccaaacagtgaggcgataatcgaaccacaaatgctaccgataccgaaaccgagataaatcacaccgtagtttttcgccaggttattgaggccaaagaactcactgaccagtgacggaaagacggtaatagtgccgccaaagttaaatgccacgcaggcaatcgctgcaaagaacgtcactgcattcaatggtgcaaacagcagggccgccatacccaccagcgatatcacctgaccaatggtaataacacggatacgggcgattttgtcagacagaatacccagcaccagacgacctgaaaggttggcgatggaaataacagtgactgcattggctgcggaaaccacatcaaggtgtgccagactttgggcgatatctttcgctaccccaatcacgtacaggccgctcatgcaggcggtcaggaacattaccgctaacatccagtactgcggtttacgcatcgactctgccagcgtgtaatctttctccaccacaccattgctggttttcacttcctgttttggtgcgtctttcattaacgttgcgccgaaaacaatcatcaacagcgcaatcgctccccaaatcacaaaggttttttccagaccgaccgtttccagcagctgcgtgtcgataaatttgaaacccaggctacccagaccataagaaccgatagcgaacgcggagatcagacctttacgctccgggaaccacttcacacagttagagagcgtcagcagataacccgcgccatctgccagtcccaccagcacaccggcgcttaaccacagcatcatcaggttgtcagaatgcgctgtcaggaagaagcctaatcccagcaaaatgccggaagccatggtgacgcgtttaacgccaaaacgttcctgtaatttgcccgcaacagaagacgaaattgccagccccagacttaacaagccgaaagagaaagcgacctggcttaccggcgcatccagcttggcggaaagcgcgccattaaacaggctccaggtataaaccgaccccagcgcaaactgggtaatgatagtaccgatgagtgtcagccagcgggtacgctgataatttgaaggtgtcatggcagtattcctgcagtaataaaaaggaaaaatctctgccgacaaccataacgaagtgcactttatgcctggggaaaaacggcatgaaatgccatcagaacggaatgaaatgccttagttcaggaatgaatgacgcgacaattattcaccaaatttattatttggtaagttagcacccactatcgccacaactattgttatttaatggtttcaattgtgactgttacgttaaaatctggcgctaacccccatcgtatacagatagtcgctattattagtggtattttctgcctgagttagcgcggcataggcggcaatattttgattgagcaacatatcagcgcctacggtgacatccagccagttgccgttctggtttgtcgccgtcatccggctcaggcctgattgcgccttccagatattctcgccaaattgctggttatagctgatttgcgcccagggtcggagatcgccaagccgggagtcaacacgccagcctaaggtactcacgctggcatgccataacggatcggtcagcgtggtagtactgtcgccaaactcgttatacatcgaggtggttgtgccatcgtaatgtaatgccgcgaccgggccggttgtaacctgttcatataaaggaaaattccagcccatactcatactgctggtcacatccacaggggtttcttccgccagattgacttccagtcccagcgccctttggctactttgaatacgttgcgacaaaatatcgttgtaatcaggttgatgatcactatcccaggtgtaacgctctgtggaaagtccgggttgcgtatcaacgatatattcttgttgccaggcgtaagctgtgttgagaaaaaaggcactgattaccacgctcgccagcaggcttagctgccagcgaccaccgcttttttttatgatcattaacacgactccagggaagagccgaattcggcaatattattgtcattgtatgaaggatatcgggcatagtagccctgtattaaatattgactttttcaccgatgcgtcaagaaaagcggctgaaatttttacgatcgggtacatagcgagggaaagtatggaacgttgcggctgggtgagtcaggacccgctttatattgcctaccatgataatgagtggggcgtgcctgaaactgacagtaaaaaactgttcgaaatgatctgccttgaagggcagcaggctggattatcgtggatcaccgtcctcaaaaaacgcgaaaactatcgcgcctgctttcatcagttcgatccggtgaaggtcgcagcaatgcaggaagaggatgtcgaaagactggtacaggacgccgggattatccgccatcgagggaaaattcaggcaattattggtaatgcgcgggcgtacctgcaaatggaacagaacggcgaaccgtttgtcgactttgtctggtcgtttgtaaatcatcagccacaggtgacacaagccacaacgttgagcgaaattcccacatctacgtccgcctccgacgccctatctaaggcactgaaaaaacgtggttttaagtttgtcggcaccacaatctgttactcctttatgcaggcatgtgggctggtgaatgatcatgtggttggctgctgttgctatccgggaaataaaccatgattcgggaagcgcaacgttcagaactccccgcgatcctcgaactgtggctggaaagtacaacctgggggcatccctttataaaagcgaattactggcgtgactgcattccgctggtgcgggatgcctatcttgccaacgcgcaaaactgggtctgggaagaagacggtaagcttctcggttttgtcagcattatggaaggccgatttctggcagcgatgtttgtcgcaccgaaggccgtcaggcgcggtattggtaaggcgctgatgcagtatgtgcagcagcgccatccccacctgatgctggaggtttatcaaaaaaatcaaccggcgataaatttttaccaggcacagggttttcacattgtcgattgcgcatggcaggatgaaacccaactacccacatggattatgagctggccggtggttcaaacgctgtaagtgtcagttccggaccgttgtatttttccagccatgccagcgccgtattacccgcacagccattccccagccgcgagctggggagatctttggtcagcacgttcactgcgccgtttttacaaataccgtcagcggttaaatccagatccggccatgccccttcgtgaatgcaaatcacgccaggtttaattccctcgctaatgaccgctccggcaagaatttgcccgcgtgcgttccacaaccgaacagtatcgccatcttgtatgccgcgctcctgggcatcgtcaggatgaatggtgacaggctcacgatttgccaccgcgtacaattcgcgcagagaactgtaattcagctggctgtgcaggcggtgcgccggatgggcagaaagtacctgcaactgttctggttcggcattgccctgccattcgtccggctccagccacattggatgcccagggcaatccgggtaaccgtaatcggcaatacgctgtgagaagatttcaatcttgccgctggcggtttttaacggatgcgccagcggatcgcggcaaaaatcagcgaagcgaataaaccgctcgctgtccgggttttccggcatctcaattaactggttggcttgccagaactcagcaaatggcggcaattcaacctgctggcttgccccgcgctgtcgggcaacgttataaaacgtttccagccattgcagctcactttttccttccgtaaaacgtgcataaccgcccttctcccagcgttcacttaactcggcaaaaacatcaaaatcattacgcgcttcatagcgtggcggcaccacttgcttcatcggcaccagatgctgattactgtaatcaccggtcatggtgagatcattacgctcaaaagaggtagtcgcaggcagaacgatatccgcgtgttttgccgccgccgtccagaagcattcagagatcaccaccagctccggtttttgccaggcacggatcaggcgattggtatcctgatgatgagtaaagttggcaccgcccgcccaccagataaaacgaatatccgggaaatgtcggttcataccgttgtgttgatatgcgccaccagggttttccagtgcttcaacaatgcgggcaacagggattttatccaccgcatcgcagccacccggcaagctgccctgcatggaagagagcaccgcagaacgccgcgtggggttaccaccattggcaaaatggtaagaaagaccaaaaccgccgccgggtgtgccgatttgccccaacattgctgccagcgtgacgatcatccagtgtttttgctcaccaaactgttggcgctgcattccccagcctgccatcagcatggtggtattttggtggaaaatagccgccagctcgcggattttcgctgcgccaacaccacaaatctctgctgcccattcggcggttttcgctattccgtcactctcgcccagcaaataagaggcgaagacggcataacctgtggtgcaacgcgccagaaacgcttcgtcgtgccaaccattttccaccagcgtatgggcgatccccagcatcagcgcaacatcggtgcccatgtgcggtgccacccactccattttatcgccaaagaaatcgacggtttccgatcgcattggatcaatgcagatcagctttttcccgctgtcacgcagtgcagaaaagtaagaaagcccctgctcatcggatgcattccacgcaattttcagcgtattgagtgggttagcactccacagcaccacgacatcgctatgttccagcaccagcggccaactggtctgctgttgataaacttcactaccacccacgacatacggcatgatcgcctgtgccgcgccggtcgaataatcccccagatgcccggtataaccgcctgccagcgccatatagcgttgtaataatgtcgaggccttatgcagcacgccgtttgaacgccagccgtaggaaccagcaaaaatcgatgccggaccataagcctcacgaatgcgtttatgttgttggtgaataagatccagcgcctcatcccaactcacgcgaacaaattcatcctgcccacgaatgccttgcgggttttccggtgacgcaagaaagccttttcgcaccattggaaatcgtacccgcgtattgctgtgaacctggtcgcgaaccgcgctctgcaaggagttttccattcctgtggctaacgcgccacgcgagctaaacacggtttcgccgtcggtttcaaccagcatgggcccccaatgggcggcagtcagaacggaatatcgtgaggatgagttggccaaaccgaagactcctgaaaggttagatgtattgagcagttaaatattacttacaaatttccgagtattcccaggaataatcttcatgttcacgcggcataatctcccgccacggaacccgtggcaaagaataaaaaggttattaaggattaacaatgaagaaacgtgtttatcttattgccgccgtagtgagtggcgctctggcggtatctggctgcacaactaacccttacaccggcgaacgcgaagcaggtaaatctgctatcggcgcaggtctgggctctctcgtgggcgcgggtattggtgcgctctcttcttcgaagaaagatcgcggtaaaggcgcgctgattggcgcagcagcaggcgcagctctgggcggcggcgttggttattacatggatgtgcaggaagcgaagctgcgcgacaaaatgcgcggcactggtgttagcgtaacccgcagcggggataacattatcctcaatatgccgaacaatgtgaccttcgacagcagcagcgcgaccctgaaaccggcgggcgctaacaccctgaccggcgtggcaatggtactgaaagagtatccgaaaacggcggttaacgtgattggttataccgacagcacgggtggtcacgacctgaacatgcgtctctcccagcaacgtgcggattccgttgccagcgcgttgatcacccagggcgtggacgccagccgcatccgtactcagggccttggcccggctaacccaatcgccagcaacagcaccgcagaaggtaaggcgcaaaaccgccgtgtagaaattaccttaagcccgctgtaatccctttcatgccaggtgatgcagaaatcacctggcattcttcagttttccttcatcatatttcaggctaaggtgatcgccttatcagtgaatggagagaagcatgaagccgtccgttatcctctacaaagccttacctgatgatttactgcaacgcctgcaagagcatttcaccgttcaccaggtggcaaacctcagcccacaaaccgtcgaacaaaatgcagcaatttttgccgaagctgaaggtttactgggttcaaacgagaatgtaaatgccgcattgctggaaaaaatgccgaaactgcgtgccacatcaacgatctccgtcggctatgacaattttgatgtcgatgcgcttaccgcccgaaaaattctgctgatgcacacgccaaccgtattaacagaaaccgtcgccgatacgctgatggcgctggtgttgtctaccgctcgtcgggttgtggaggtagcagaacgggtaaaagcaggcgaatggaccgcgagcataggcccggactggtacggcactgacgttcaccataaaacactgggcattgtcgggatgggacggatcggcatggcgctggcacaacgtgcgcactttggcttcaacatgcccatcctctataacgcgcgccgccaccataaagaagcagaagaacgcttcaacgcccgctactgcgatttggatactctgttacaagagtcagatttcgtttgcctgatcctgccgttaactgatgagacgcatcatctgtttggcgcagaacaattcgccaaaatgaaatcctccgccattttcattaatgccggacgtggcccggtggttgacgaaaatgcactgatcgcagcattgcagaaaggcgaaattcacgctgccgggctggatgtcttcgaacaagagccactgtccgtagattcgccgttgctctcaatggccaacgtcgtcgcagtaccgcatattggatctgccacccatgagacgcgttatggcatggccgcctgtgccgtggataatttgattgatgcgttacaaggaaaggttgagaagaactgtgtgaatccgcacgtcgcggactaagccgcgactgcgtagagtaaagcccgataatcgctcgggcttttactctttattgggttgcagtaactgctgtagtccaggcctgattaaacgcctgatgctgtgccggtaatggcgcaatcagtttgttatattcacttgcctgctgtgaagtcgggaactggatgccatttgcgacaaagctcacctgagtaccttgctgagcaatgtagtctccaaccatcaccagttgttgcgtgaaagtttgtgccgccggaatcaacggttgcaatgcatcagctggcgtcgttaccactttggtgaatgcctgatcaaagaccggtttcaaatcatcgctctgttttagcgcagagtgcgcagcatcggcctgcaacttcgcattttgcagttgttgcgccagcacacccagcgaaccgttcatttcacgcagcggaccgctttgcgtaacgtaatcctgcggtacgcgaattgcgttaacgctgtctacaaccgggcgcagaccggaatccatcgcctgattcacctgctgagaataaccatacagaatcgcgtaatcagagacaaaaggaccaaactgttttttctgatcggcagtcagggttggtagacgttcaccgctacgcatcactgtattctgcaggaagtcgataaacgctttacgctgatcgccttctttatcaaaacacccactcaggctaactaccattaataacgccgcaagaggcgcaaaccagcgagagcaggactttcctgtcgccattttcttactcctttcacccaaaaaaagcgcacaacgacacacgcgtgtctgacgtgacaaggatagtccaggacaggcttgcaggataccctttctacgtaatcttcctggtaaaatcatggagaaaatgaaacaaggttaatttgttgtttcattgttaaaaaatgatagtgccgttgccttttttgtagccagagatttacgccttcgcagaaggttagattttcgaaatctttacaaaacaggagtggtaagagatatatcggcatttatcagatcgttaggtggctataagtcacgctaaatgacaggctgaatcgaatcatagccagagcatgccctgacttcaccccgctgtgtctgcttttcccgactattcttaatgagcttcgatgcaattcacgatcccgcagtgtgatttgaggagttttcaatggaatataaagatccaatgcatgagctgttgagcagcctggaacagattgtttttaaagatgaaacgcagaaaattaccctgacgcacagaacaacgtcctgtaccgaaattgagcagttacgaaaagggacaggattaaaaatcgatgatttcgcccgggttttgggcgtatcagtcgccatggtaaaggaatgggaatccagacgcgtgaagccttcaagtgccgaactaaaattgatgcgtttgattcaagccaacccggcattaagtaagcagttgatggaatagacttttatccactttattgctgtttacggtcctgatgacaggaccgttttccaaccgattaatcataaatatgaaaaataattgttgcatcacccgccaatgcgtggcttaatgcacatcaacggtttgacgtacagaccattaaagcagtgtagtaaggcaagtcccttcaagagttatcgttgatacccctcgtagtgcacattcctttaacgcttcaaaatctgtaaagcacgccatatcgccgaaaggcacacttaattattaaaggtaatacactatgtccggtaaaatgactggtatcgtaaaatggttcaacgctgacaaaggcttcggcttcatcactcctgacgatggctctaaagatgtgttcgtacacttctctgctatccagaacgatggttacaaatctctggacgaaggtcagaaagtgtccttcaccatcgaaagcggcgctaaaggcccggcagctggtaacgtaaccagcctgtaatctctgcttaaaagcacagaatctaagatccctgccatttggcggggatttttttatttgttttcaggaaataaataatcgatcgcgtaataaaatctattattatttttgtgaagaataaatttgggtgcaatgagaatgcgcaacgccgtaagtaaggcgggaataatttcccgccgaagactcttactctttcaatttgcaggctaaaaacgccgccagctcataactctcctgtttaatatgcaattcacacagtgaatctcttatcatccaggtgaaaaataaaagcgtgaaacaaatcactattaaagaaagtaatctatatttctgcggcattcccagcctcctgtgttgatttccaacgagtatgtactgcacccattttgttggacgatgaaatggaatagcccctaatatgtcaaagccaaaatacccttttgaaaagcgccttgaagtcgtgaatcactacttcacaactgatgatggttacaggatcatctcggcacgttttggtgtcccccgaacccaggtcaggacatgggttgccctctatgaaaaacatggagaaaaaggtttaattcccaaacctaaaggcgttagtgctgatccagagttgcgtattaaggtcgtgaaagctgtgatcgagcagcacatgtcccttaatcaggctgctgctcactttatgcttgctggtagtggttctgtagccaggtggctgaaggtctatgaagagcgcggagaagctggtttacgcgcgctcaagattggcaccaaaagaaacattgcaatatcagttgatccagaaaaagcggcatcagcattggagctgtcaaaagaccgacgcattgaggatcttgaaaggcaagttcgatttcttgaaacgcggcttatgtatctaaaaaagctgaaagccttagctcatcccacgaaaaagtgaaagtactcaacgagctaaggcagttttatcctcttgatgagcttctcagggctgcggagataccgcgcagtacgttttattatcatctaaaggctctcagcaagcctgacaagtatgcggacgttaaaaagcgtattagtgagatttatcacgagaatagaggccgatacggataccgtagggtaacgctgtctcttcatcgagaagggaaacagattaaccataaagctgttcagcgcctgatgggaaccctctcacttaaagcagcgattaaggtcaagcgataccgctcttacagaggagaggtagggcaaaccgcccctaatgttctccaaagagatttcaaggctacgcggccaaacgagaagtgggttaccgatgttactgaatttgcagtcaatgggcgcaagctgtatttgtctccagtaatagatctcttcaacaacgaagttatttcttacagcctttcggaaagaccagtgatgaacatggttgagaatatgctcgatcaggcattcaaaaagcttaatcctcacgagcatcctgttctgcactctgaccagggatggcagtatcgtatgagaagatatcaaaatatccttaaagaacatggtattaaacaaagcatgtccagaaaaggcaattgtctggataatgctgtggtggagtgtttctttggaaccttaaagtcggagtgtttttatcttgatgagttcagtaatataagcgaactgaaggatgctgttacggaatatattgaatactacaacagcagaagaattagcctgaaattaaaaggtctgactccaattgaatatcggaatcagacctatatgcctcgtgtttaactgtccaactttttggggtcagtacaaactttgatttatagtcaggtggggcttttctctgtctgcctttcggtgaatacctgagacaaacagtctcaagcacccgtggctattctagcttaataagtttgtttcttctccttgatataatcctaaaaaaatctcataaaattaatatatgagataatctttattcagcagaagattattaaaggttgctgtattatttagcgataaaaaaagcctgccagatggcaggctatttaataacggcgttattattgcaacagcgaaatatccgcaacgcgcaggaacagttcgcgcagtttctccagcatggtcagacggttgatacgcaattctttgtcatcaaccatgaccatcactttatcgaagaaagcatcaaccggttcacgcagctcagccagttcgaccagcgcatcctggtaacgaccttccgtaaagtacggctccagcttgtcacgtagcaccacaacctgcatcgccagtttaatttcttccggctctttcagggtagaggcattcacgcggtcgctcagcacttcgtcagatttcgccagaatgttagatacacgtttgttcgccgccgccagtgcagcagctgcatccagggtacggaaatgcgataccgctttcatacgggcatcgaaatcagccggacgagtcggacgacgcgccagtaccgcctggatggtgtcaacggtataaccttcgtcctgataccaggcgcggaagcgaccgagcataaagtcgataacatcatcaactacgttggcattagtcagcttatcgccatacagacgcaccgcttcttcggtcagcgtttgcagatcaaggttgaggttcttctcaacgataattcgcagcacgccaagcgcggcacgacgcagcgcaaacgggtctttgtcgcctttcggatgctgaccgataccgaagatacccgccagggtatccatcttgtcagcaatcgccagcgcacaagctactgggttggacggcaggtcatcaccagcaaaacgcggctgatactgctcattcagcgccaccgcgacatcttccgcttcgccatcgtgacgcgcatagtgcatccccataacgccctgggtgtcggtgaactcgaagaccatgttggtcatcaggtcgcacttagacagcagacccgcacgggtagcgtggttaacgtcagcgccaatctgttcagcaatccagccagccagcgcctggatgcggtcagttttgtcgcgcagcgtccccaactgttgctggaacaacacggtttgcaggcgcggcaggttatcttcaagacgttttttacggtcggtgttgaagaagaactcggcatccgccagacgcggacgaacgactttctcgttaccggagataatctgctgcggatctttcgattcgatgttggcaacgaagataaagttcggcagcagtttgccgtcgttcgcatacaccgggaagtatttctggtcacctttcatggtgtaaaccagcgcttcagccggcaccgcgaggaatttctcttcgaattttgcggtcagaacgaccggccactccaccagcgaagccacttcttccagcaggctttcgcttaagtcagcgttaccgccaatcttacgcgctgcttcttcggcatcggctttaatcttcgccttacgttcttcgtaatcggcgatgactttcccacgctcacgcagaatttccggatactgatcggcgttatcgatggtgaattccggctcgcccataaagcggtggccgcgaatcacgcgatcggactgaatgcccagaatggttgccggaatgactttgtcgcccagcagcagggtcacggtgtgcaccggacgcacgaagtgcacgtcgcttgcgccccaacgcatcagtttcgggatcggcagtttcgccagagaagtcgcaaccatattcggcagcagtgcttcggtgctttcgcccttcacatgggcgcgatacagcagccattcgcctttatcggtagtcagacgctcagcctggtcaacggtaataccgcaaccacgcgcccaaccttctgccgctttgctcggtttgccttcagcgtcgaacgcctgggcaatcgccgggccgcgtttttcgatttcacgatccggttgcgcttccgccaggttagctactttcagcgccagacgacgcggagcagcaaaccattgaacggtgccgtgtgcgaggccagcgttatccagctccgcagtaaagttcgcagcaaaggactcagccaggctgcgcagtgcttttggtggcagctcttcagtgccgatttccaccagaaaagttttctcagacatagccgcctcttacttatctttgttgcacatcgggaagccgagggcttcacgggaagcgtagtatgcttctgccactgctttggtcagggtgcgaatgcgcagaatgtagcgctgacgctcggtgacggagatggctttacgcgcatccagcaggttgaagctgtgggcggctttcagaatacgctcgtaggctggcagcggcagcggattttccagcgccagcagctgctgcgcttctttctcgtactgctcgaagcaggtgaacaggaagtccacatccgcgtattcgaagttgtaagtggactgctccacttcgttctgatggaacacgtcgccgtaggtggttttacccagcgggccgtcgctccagaccaggtcgtaaacgctgtctacgccctgaatgtacatggccagacgttccagaccgtaggtgatctcgccggtaaccggtttacactccagaccaccaacctgctggaagtaagtgaactgcgtcacttccatgccgttcagccacacttcccagcccagtccccaggcacccagcgtcgggttttcccagttatcttccacgaaacggatgtcgtgaatagtcgggtccatgcccagctctttcagagaaccgaggtacagctcctgaatattgtccggcgatggcttaatgaccacctggaactgatagtagtgctgtaaacggttggggttttcgccgtagcgaccatcggtcgggcgacgagaaggctgaacataagcagccgccatcggttctggccccagctcgcgcagacaggtcattgggtgagaggttcccgcgccgacttccatgtccaatggttgaacaatggtgcagccctggcgagcccagtaatcctgtaaggtcaggatcaagccctggaaggtcctggtatcaaacttttgcatattatttcgtgctggatacgtgtggatttaaaggaagggatcagtatacccgctggatggaagatatacagtacgaaacgggaaaaagcagggcttaacgcatggaaagatgcaaaaaatggccatccgcgtcaaaagaacagacaaactgctctttacggaaggtataaccgcgcatttcatagcttccctggaactgttcgaaggcggtgacgtcgattttttgctcgccggtgttataacgttttgccgcctgatccttgcataacgcttccatattcaacgaacgcagaggatcaacctttacccgttgtgctttctgcacgggtgacggtatagaacaacccactagcaccataagcgccattgccggaaagaaagcgttcatcatcattaaattaccgtctggtttgcaggtgagtcttattatttatatcggtatagtggctgatatcttacgaatttccttaagcctctataagctgtagtgataaaactcagattattccagtgcgccaaccaaatgatttatcggtcagactttttttaaccagatacagagacacagatgcagcccaaaatttactggattgataacctgcgagggatagcgtgtttaatggtggtgatgattcacaccactacctggtatgtgaccaatgctcatagtgttagccccgtcacatgggatatcgccaatgttctgaattctgcctctcgtgtcagcgtgccgctatttttcatgatttccggctatctcttttttggcgaacgcagcgcccagccgcgccatttcttgcgtatcggcttatgtctgattttttatagcgcaatcgcactgctctacattgcgctgtttacctccatcaatatggagttagcgctgaaaaacctgctgcaaaagccagtgttttaccacttgtggtttttcttcgcgattgcggtgatttatctggtttcaccgctgattcaggtgaagaacgtcggcggaaaaatgttgctggtgctaatggcggtgattggcattatcgctaacccaaacacagtgccgcagaaaattgacggttttgaatggctgccaattaacttatatatcaatggcgatactttttactacattctgtatggcatgttgggccgcgctatagggatgatggacacacagcataaagcactgtcgtgggtgagcgccgcgctgtttgcgacgggggtttttattatctctcgcgggacattatatgaattgcagtggcgcggaaattttgccgatacctggtatctttactgtgggccgatggtttttatctgcgcaatcgcgctattgactctggttaaaaacacgctggatacgcgtaccattcgcggacttggcttaatctcccgccattcattgggtatatacggattccacgccttgattatccatgcgctgcgcacccggggaattgagcttaaaaattggccaatactggatattatttggatcttttgcgcgacgttggcagcgagtttgttactttctatgctggtacaacgaatcgacagaaacagattagtgagttaagtaaaagcccggtcacattggactgaccgggcttacgtgagttattcgctgtattcttcctgggtaacctgtgtttcttttggtgggtttattccggcatcacgaatatttttctgcaccgctactgcaccaaacaagcttaagaagaaagccagtccataaaaacctttttcgctgagtaataatgtcgcattccacagacctaccatcagtaatgcaacagagataataaagacagtcaggcaggtcatataataaatggaagtggtcggtatgccttcatacttgtcccgaacggtcttttgataagacgccgcagaaaacagtcctaataccagtacggcaaaataatatcctttttcatttaactgcatctctgcattccatagccctaacagataggtaacgataccaccaacgagagctatccatgacacaatactaaaggccggtgaataggttgatattttgttgtccatcacagtattcctttcattcctgaatatgtaagagctttatgttgctcatgccgagcgaaacaaacgcatttgaccaaacaagcagacaaaaaaggcgatgggatagatcaccatttcataagtattgataggtgcgtttaaaacaccgataaacaagagaccgatagtgattaacgcaactaactggcagatatgggtaaaaaaatcatccagttgcccgagtttttctgcgcgaagatatgcatagttgccaaaagttgctgtcattaacacgccaagaaaatagccttttccacttaacaatgggcatgagatccatagcccaaccagataaaccagcgccccgacaacaaataatagttttgccacagtctttgaggttttcataacgatctccatatctaccagcgatacattacgagtaaccaacgaaagacaaaactgaaaaatgccattaacaaatgattttcagaataaattcatactaaatattaattaattactgagatatatagatgtgaattatcccccacccggtcaggcaggggataacgtttacgccattaatggcagaagttgctgatagaggcgacggaacgtttctcgtcgtggctgataagcggcataacgctgcgcatctggtagatgcgactgttctaacggtagttgcggcaacaattcaatgagcgatttctctggattcgccgcgatctgcgccagccttgctgcgcccagtgctggccccacatccccccccgtacggtaatcgagctgctgaccgctgatatccgccagcatctgacgccagtactcactacgcgccccgcccccaatcaacgtaacactttgcggtttaataccgcaggcatgcacgacatccatgccatctgccagcgcataacccacgccttccagcactgctcgcgccagttcattggggccatgttgatgagtcaaaccaaagaaaacccccttcgcctggggattattgtgtggcgtacgctcgccggaaagataaggcagaaaccaaactggctcggcactttcatcagcctgttgagctgcagcgattaaagctgggacattgctcaggccggttaatttcgcggcccaatccagacacgacgctgcactcagcatcacagacattaaatgccaacgttgcggtagcgcatggcaaaagctatgtacggcgctttctggcttgcttaagaacccttcgctgacagcaaaatagacccccgacgtccccagcgataacattgcctgattagcatcaaccattcccacaccaactgcaccagctgcattgtcgccaccgcctgcgacaactggcaccgtcgccataccccacgctttcgcaacttcaggtaacaaagcaccagtaatttcgctgccttcgtataatgcgggcatctggtcacgagataagtcgcaagcctgcagcatgacgtcactccagtcacgctttgcgacatccagccacatggtgccagctgcgtcagacatatcgctggcaaactcccccgtcatacgcagacgcaagtaatctttcggtaataatactttgtcgatttgacggaatatctccggctcatgccgctgaacccatagcaatttaggcgcagtaaatccgggcatcatcaggttgccggtaatcacccgcgattgcggaactcgcgcttccagcaaagtgcactcttgcgcacagcgcccgtcgttccacaaaatggcagggcgtaacacccgttgctgagcatccagcaaggttgctccgtgcatctggccggcaatacccaatgctttaacgtcctgcagagaatgctgatcgcccagagctttcattgcgcgatcagttgcctgccaccactgttccgggtcttgttccgaccagagtggatgcgggcgcgaaacggtcagcttttccgtttgcgcagcaaccacctcaccctgctcgttgagcaaaataacttttacgcccgaggtgccaagatctatcccgatatacatatcgatcgttccttaaaaaaatgcccggtatcgctaccgataaccgggccaacggactgcacagttagccgttatttgtcgaacagataatggtttaccagattttccagttgttcctggcgaccactctgatgcaccggagacaaatgatgttcctgagcatatttggctaaatctgccagtgacatttggcctttcaggatttgctggcccaattcgctattccagccggaataacgctgcgcgatgcgtttatccagctcgccatcttcaatcatgcgcgctgcaattttcagcgccagtgccatcgtatccatcgcgccgatatgaccgtaaaacagatcatatttatcagtactttgacgacgtactttggcatcgaagttcagaccaccggtggtgaaaccgcctgctttgagaatttcatacatcaccagcgcattctcttccacactgttcgggaactggtcggtgtcccagcccagttgcgcatcgccacggttggcgtcgacagaaccgaacaggccaagcgcaatggcggtggctatttcatgatggaaagagtgacctgccagcgtcgcgtggttagcttcaatgttcagtttaatctctttttccagaccaaactgtttcaggaagccatagaccgtcgcggcatcgtaatcatattgatgtttggtcggttcttgcggtttcggttcgataagcaacgtgccctggaaaccgattttatgtttatgctcaaccaccatctgcataaagcggcccagttgttcacgctcctgacgcaagtcggtatttaacagcgtttcgtaaccttcacgaccgccccacaggacatagttttcaccgcccaatttatgggttgcttccatcgctgtaacaacttgcgttgccgcccagctgaagacttcaggatctgggttcgtcgccgcacccgcgccgtagcgagggtttgtaaagcagttggccgttccccacagcagcttcacgccgctctcttcttgcttgcctgccaggacatcaaccatttgcgcaaaattattgatgtactcttttaacgacgcgccctcaggggaaacatccacatcgtggaagcaataaaatggcacatgtaacttgtggaaaaactcaaatgcgacatctgctttacgcttcgccaacgccagtgcctcaccaggctgctgccacggacgattaaacgcccccacaccaaacatatccgccccgttccagcagaaggtgtgccagtagcaggcggcaaaacgcaagtgctcttccatacgcttacccaacaccagttcgtcgggattgtagtgacggaatgctaacgggtttgaggattttgagccttcataacgaacgcgatcgagctggtcaaaataggcttgcatattgaactccataatcaggtaatgccgcgggtgatggatgatgtcgtaatattgggcactccctttcagttgctcaattatgttatttcacactgctattgagataattcacaagtgtgcgctcgctcgcaaaataaaatggaatgatgaaactgggtaattcctcgaagagaaaaatgcaataagtacaattgcgcaacaaaagtaagatctcggtcataaatcaagaaataaaccaaaaatcgtaatcgaaagataaaaatctgtaattgttttcccctgtttagttgctaaaaattggttacgtttatcgcggtgattgttacttattaaaactgtcctctaactacagaaggccctacaccatgaaaataaagaacattctactcaccctttgcacctcactcctgcttaccaacgttgctgcacacgccaaagaagtcaaaataggtatggcgattgatgatctccgtcttgaacgctggcaaaaagatcgagatatctttgtgaaaaaggcagaatctctcggcgcgaaagtatttgtacagtctgcaaatggcaatgaagaaacacaaatgtcgcagattgaaaacatgataaaccggggtgtcgatgttcttgtcattattccgtataacggtcaggtattaagtaacgttgtaaaagaagccaaacaagaaggcattaaagtattagcttacgaccgtatgattaacgatgcggatatcgatttttatatttctttcgataacgaaaaagtcggtgaactgcaggcaaaagccctggtcgatattgttccgcaaggtaattacttcctgatgggcggctcgccggtagataacaacgccaagctgttccgcgccggacaaatgaaagtgttaaaaccttacgttgattccggaaaaattaaagtcgttggtgaccaatgggttgatggctggttaccggaaaacgcattgaaaattatggaaaacgcgctaaccgccaataataacaaaattgatgctgtagttgcctcaaacgatgccaccgcaggtggggcaattcaggcattaagcgcgcaaggtttatcagggaaagtagcaatctccggccaggatgcggatctcgcaggtattaaacgtattgctgccggtacgcaaactatgacggtgtataaacctattacgttgttggcaaatactgccgcagaaattgccgttgagttgggcaatggtcaggaaccaaaagcagataccacactgaataatggcctgaaagatgtcccctcccgcctcctgacaccgatcgatgtgaataaaaacaacatcaaagatacggtaattaaagacggattccacaaagagagcgagctgtaagcgttacgccccagcgcggagcgggggcgtgatttctctccatgccgcgtgaatgaattggcttaggtggagtcgttatgccttatctacttgaaatgaagaacattaccaaaaccttcggcagtgtgaaggcgattgataacgtctgcttgcggttgaatgctggcgaaatcgtctcactttgtggggaaaatgggtctggtaaatcaacgctgatgaaagtgctgtgtggtatttatccccatggctcctacgaaggcgaaattatttttgcgggagaagagattcaggcgagtcacatccgcgataccgaacgcaaaggtatcgccatcattcatcaggaattggccctggtgaaagaattgaccgtgctggaaaatatcttcctgggtaacgaaataacccacaatggcattatggattatgacctgatgacgctacgctgtcagaagctgctcgcacaggtcagtttatccatttcacctgatacccgcgttggcgatttagggcttgggcaacaacaactggttgaaattgccaaggcacttaataaacaggtgcgcttgttaattctcgatgaaccgacagcctcattaactgagcaggaaacgtcgattttactggatattattcgcgatctacaacagcacggtatcgcctgtatttatatttcgcacaaactcaacgaagtcaaagcgatttccgatacgatttgcgttattcgcgacggacagcacattggtacgcgtgatgctgccggaatgagtgaagacgatattatcaccatgatggtcgggcgagagttaaccgcgctttaccctaatgaaccacataccaccggagatgaaatattacgtattgaacatctgacggcatggcatccggttaatcgtcatattaaacgagttaatgatgtctcgttttccctgaaacgtggcgaaatattgggtattgccggactcgttggtgccggacgtaccgagaccattcagtgcctgtttggtgtgtggcccggacaatgggaaggaaaaatttatattgatggcaaacaggtagatattcgtaactgtcagcaagccatcgcccaggggattgcgatggtccccgaagacagaaagcgcgacggcatcgttccggtaatggcggttggtaaaaatattaccctcgccgcactcaataaatttaccggtggcattagccagcttgatgacgcggcagagcaaaaatgtattctggaatcaatccagcaactcaaagttaaaacgtcgtcccccgaccttgctattggacgtttgagcggcggcaatcagcaaaaagcgatcctcgctcgctgtctgttacttaacccgcgcattctcattcttgatgaacccaccaggggtatcgatattggcgcgaaatacgagatctacaaattaattaaccaactcgtccagcagggtattgccgttattgtcatctcttccgaattacctgaagtgctcggccttagcgatcgtgtactggtgatgcatgaagggaaactaaaagccaacctgataaatcataacctgactcaggagcaggtgatggaagccgcattgaggagcgaacatcatgtcgaaaagcaatccgtctgaagtgaaattggccgtaccgacatccggtggcttctccgggctgaaatcactgaatttgcaggtcttcgtgatgattgcagctatcatcgcaatcatgctgttctttacctggaccaccgatggtgcctacttaagcgcccgtaacgtctccaacctgttacgccagaccgcgattaccggcatcctcgcggtaggaatggtgttcgtcataatttctgctgaaatcgacctttccgtcggctcaatgatggggctgttaggtggcgtcgcggcgatttgtgacgtctggttaggctggcctttgccacttaccatcattgtgacgctggttctgggactgcttctcggtgcctggaacggatggtgggtcgcgtaccgtaaagtcccttcatttattgtcaccctcgcgggcatgttggcatttcgcggcatactcattggcatcaccaacggcacgactgtatcccccaccagcgccgcgatgtcacaaattgggcaaagctatctccccgccagtaccggcttcatcattggcgcgcttggcttaatggcttttgttggttggcaatggcgcggaagaatgcgccgtcaggctttgggtttacagtctccggcctctaccgcagtagtcggtcgccaggctttaaccgctatcatcgtattaggcgcaatctggctgttgaatgattaccgtggcgttcccactcctgttctgctgctgacgttgctgttactcggcggaatgtttatggcaacgcggacggcatttggacgacgcatttatgccatcggcggcaatctggaagcagcacgtctctccgggattaacgttgaacgcaccaaacttgccgtgttcgcgattaacggattaatggtagccatcgccggattaatccttagttctcgacttggcgctggttcaccttctgcgggaaatatcgccgaactggacgcaattgcagcatgcgtgattggcggcaccagcctggctggcggtgtgggaagcgttgccggagcagtaatgggggcatttatcatggcttcactggataacggcatgagtatgatggatgtaccgaccttctggcagtatatcgttaaaggtgcgattctgttgctggcagtatggatggactccgcaaccaaacgccgttcttgattttgataaaaattttctcaaagccggttacgtattaccggttttgagtttttgcatgattcagcaggaaaagaaccatgtttactaaacgtcaccgcatcacattactgttcaatgccaataaagcctatgaccggcaggtagtagaaggcgtaggggaatatttacaggcgtcacaatcggaatgggatattttcattgaagaagatttccgcgcccgcattgataaaatcaaggactggttaggagatggcgtcattgccgacttcgacgacaaacagatcgagcaagcgctggctgatgtcgacgtccccattgttggggttggcggctcgtatcaccttgcagaaagttacccacccgttcattacattgccaccgataactatgcgctggttgaaagcgcatttttgcatttaaaagagaaaggcgttaaccgctttgctttttatggtcttccggaatcaagcggcaaacgttgggccactgagcgcgaatatgcatttcgtcagcttgtcgccgaagaaaagtatcgcggagtggtttatcaggggttagaaaccgcgccagagaactggcaacacgcgcaaaatcggctggcagactggctacaaacgctaccaccgcaaaccgggattattgccgttactgacgcccgagcgcggcatattctgcaagtatgtgaacatctacatattcccgtaccggaaaaattatgcgtgattggcatcgataacgaagaactgacccgctatctgtcgcgtgtcgccctttcttcggtcgctcagggcgcgcggcaaatgggctatcaggcggcaaaactgttgcatcgattattagataaagaagaaatgccgctacagcgaattttggtcccaccagttcgcgtcattgaacggcgctcaacagattatcgctcgctgaccgatcccgccgttattcaggccatgcattacattcgtaatcacgcctgtaaagggattaaagtggatcaggtactggatgcggtcgggatctcgcgctccaatcttgagaagcgttttaaagaagaggtgggtgaaaccatccatgccatgattcatgccgagaagctggagaaagcgcgcagtctgctgatttcaaccaccttgtcgatcaatgagatatcgcaaatgtgcggttatccatcgctgcaatatttctactctgtttttaaaaaagcatatgacacgacgccaaaagagtatcgcgatgtaaatagcgaggtcatgttgtagcgatgatgagaattgtcggcgtcacatcaggtaacgctgcgtggttgtcggatgcggcgtgaacgccttatccgacctacccgccaggcatgataaaacgcaccaacaacgcttcaggctcgtagctcaactgcctgagacaaagtaaaaagccttatccgactgacaagtcggataaggctcaaggaaatgcaattacatatgcgccgcgattaaccgttggttatcctggtacattgcgaacaggtagttgttataactcttccctttggtcgagtagcccttcagcttgtgaatcatcgctgtggcagtcacttcctgatccgctttacgcagctgcgcacgcgatttacggaacgaagagtaagccgggtgcgtattcaggttagtgacataggcgctcaccgattctttgacagaactaaactgtgagtaccctttcactttacctggcgcattggtacaacgtcctttcatgcatttcatgccgaacaggttgttgttgttgcgcgccagcttcgacgttccccaaccgctttctgctgcagccatcgtcgccaccatactggtggggataatgtctacgcgttcaagcaaggtattccacgggatttttcgcgtattaccggaccacttcaccttgtagcgtttggcgatgtctttcagacgcgcacgctcagcaggtgaccattggccctgatactgttttgaaatgagccagttacgttccgcagtaatggccgcattttggctggtaatgtaaggcattacggtccggagaaacgcctttttccttggtgttccggaagggtattttcgcaaatcaggaagtgaactactctttgcactattgcgagaatactcttgtttactgcttacctgtttattactagctttagttaagtgggacttttgactcgctgttgttgtgtgcgtcttcgctaacacctcactcgaaaacaccagagtgagtaacataagaatcatcgccccatatcgtcgtatgggagtcaaaatcatcaggtctcctggtcggatttaatcattccaacaccttatatttttcacaaatttgagagttgaatctcaaatcatatcaaaaatagctgtcaagagcaccccaaggaatagtccaaatctgaaactatgtcacgtgttaacgattcagattggcgctaaatcgcagaaaatgtgggggttatcgcaaaattcagccgttttttgcgcgagatcgctcacccttgcttctcatcctgtggacttaccgctcagggatgagttttgtttggcttatcgctggcaaactgtctgaaatcgcagcaataaggactcatccgccatgaaactcgccgcctgttttctgacactccttcctggcttcgccgttgccgccagctggacttctccggggtttcccgcctttagcgaacaggggacaggaacatttgtcagccacgcgcagttgcccaaaggtacgcgtccactaacgctaaattttgaccaacagtgctggcagcctgcggatgcgataaaactcaatcagatgctttccctgcaaccttgtagcaacacgccgcctcaatggcgattgttcagggacggcgaatatacgctgcaaatagacacccgctccggtacgccaacattgatgatttccatccagaacgccgccgaaccggtagcaagcctggtccgtgaatgcccgaaatgggatggattaccgctcacagtggatgtcagcgccactttcccggaaggagccgccgtacgggattattacagccagcaaattgcgatagtgaagaacggtcaaataatgttacaacccgctgccaccagcaacggtttactcctgctggaacgggcagaaactgacacatccgcccctttcgactggcataacgccacggtttactttgtgctgacagatcgtttcgaaaacggcgatcccagtaatgaccagagttacggacgtcataaagacggtatggcggaaattggcacttttcacggcggcgatttacgcggcctgaccaacaaactggattacctccagcagttgggcgttaatgctttatggataagcgccccatttgagcaaattcacggctgggtcggcggcggtacaaaaggcgatttcccgcattatgcctaccacggttattacacacaggactggacgaatcttgatgccaatatgggcaacgaagccgatctacggacgctggttgatagcgcacatcagcgcggtattcgtattctctttgatgtcgtgatgaaccacaccggctatgccacgctggcggatatgcaggagtatcagtttggcgcgttatatctttctggtgacgaagtgaaaaaatcgctgggtgaacgctggagcgactggaaacctgccgccgggcaaacctggcatagctttaacgattacattaatttcagcgacaaaacaggctgggataaatggtggggaaaaaactggatcagaacggatatcggcgattacgacaatcctggattcgacgatctcactatgtcgctagcctttttgccggatatcaaaaccgaatcaactaccgcttctggtctgccggtgttctataaaaacaaaatggatacccacgccaaagccattgacggctatacgccgcgcgattacttaacccactggttaagtcagtgggtccgcgactatgggattgatggttttcgggtcgataccgccaaacatgttgagttgcccgcctggcagcaactgaaaaccgaagccagcgccgcgcttcgcgaatggaaaaaagctaaccccgacaaagcattagatgacaaacctttctggatgaccggtgaagcctggggccacggcgtgatgcaaagtgactactatcgccacggcttcgatgcgatgatcaatttcgattatcaggagcaggcggcgaaagcagtcgactgtctggcgcagatggatacgacctggcagcaaatggcggagaaattgcagggtttcaacgtgttgagctacctctcgtcgcatgatacccgcctgttccgtgaagggggcgacaaagcagcagagttattactattagcgccaggcgcggtacaaatcttttatggtgatgaatcctcgcgtccgttcggtcctacaggttctgatccgctgcaaggtacacgttcggatatgaactggcaggatgttagcggtaaatctgccgccagcgtcgcgcactggcagaaaatcagccagttccgcgcccgccatcccgcaattggcgcgggcaaacaaacgacacttttgctgaagcagggctacggctttgttcgtgagcatggcgacgataaagtgctggtcgtctgggcagggcaacagtaacttttccggcttcccgttcgtcagtacctcgggaagccgccaaccaggataaaatgtcagccctaatcagcgttgcaggataaagcaccgctcactcttcaacagaccgatttgcaccccagcaaatgtagcgttattgttaccttccttgctacagagttcgacagatatcccgctatgacattctccctttttggtgacaaatttacccgccactccggcattacgctgttgatggaagatctgaacgacggtttacgcacgcctggcgcgattatgctcggcggcggtaatccggcgcagatcccggaaatgcaggactacttccagacgctactgaccgacatgctggaaagtggcaaagcgactgatgcactgtgtaactacgacggtccacaggggaaaacggagctactcacactgcttgccggaatgctgcgcgagaagttgggttgggatatcgaaccacagaatattgcactaacaaacggcagccagagcgcgtttttctacttatttaacctgtttgccggacgccgtgccgatggtcgggtcaaaaaagtgctgttcccgcttgcaccggaatacattggctatgctgacgccggactggaagaagatctgtttgtctctgcgcgtccgaatattgaactgctgccggaaggccagtttaaataccacgtcgattttgagcatctgcatattggcgaagaaaccgggatgatttgcgtctcccggccgacgaatccaacaggcaatgtgattactgacgaagagttgctgaagcttgacgcgctggcgaatcaacacggcattccgctggtgattgataacgcttatggcgtcccgttcccgggtatcatcttcagtgaagcgcgcccgctatggaatccgaatatcgtgctgtgcatgagtctttccaagctgggtctacctggctcccgctgcggcattatcatcgccaatgaaaaaatcatcaccgccatcaccaatatgaacggcattatcagcctggcacctggcggtattggtccggcgatgatgtgtgaaatgattaagcgtaacgatctgctgcgcctgtctgaaacagtcatcaaaccgttttactaccagcgtgttcaggaaactatcgccatcattcgccgctatttaccggaaaatcgctgcctgattcataaaccggaaggagccattttcctctggctatggtttaaggatttgcccattacgaccaagcagctctatcagcgcctgaaagcacgcggcgtgctgatggtgccggggcacaacttcttcccagggctggataaaccgtggccgcatacgcatcaatgtatgcgcatgaactacgtaccagagccggagaaaattgaggcgggggtgaagattctggcggaagagatagaaagagcctgggctgaaagtcactaaaaattgcctgatgcgctacgcttatcaggcctacatgatttctgcaatatattgaatttggaagaatttgtaggccggataaggcgtttacgccgcatctggcataaacaaagcgcactgttccggcgttgagaaacgccggaaaacgtttcaaacaggctgctgccgtagccgatgccgctgcactttctcgacatccatgcactgcaacgcctttgtcgggcaggcttcaacacaggccggtcccgtctcccgatgccagcacagatcgcacttaatcgccctcgcctttttgcgcgaagaaacgacctccatcgcaccaaacgggcaagccagcatacagcttttacagccaatgcaacgtgtttgttcaacgaaaatatgcccatgttcgcggcttatcgcgtcaacagggcagacattcgcgcacggtgcatcttcacactgatgacaggctactgccgtggtccagcagtggtctttaatgacacgaatacgggaaataaactcgtctggtgacaacgcagcgcaatcctgattctcatgatgcgacactgcgcaagccacttcacaggtacggcaaccgatacatttcgtcgcatccgcaataataaaccggttcatgatcactcctttgcactaaaacagcagagtgccagagagcgcgtccctactgctttgatccaacgaaggaaatgttaaagttttggcacttgtccaaagcgttatgtgatcgcgcccaggtcatccctgacagtaaatcccagttcattagaaatagcctgcgcggtttcacgcagtggtttcaggagatttttctctcccacctgtttcagacgtgatgtcgaaagcgaaatcgacacggcgtacggcacccgcccatgaatatcaaacaccggaacagcaatacaggagacgccgagttcgttttcttctctgtccatcgccgctccgctttcacgaatgtgcgccagttcgtcgaacatcgcgggcagctcggtaatggtattgcgggttaacggctggatctcatgctgatggctttcccagtatgacttcacgtagtccgggtgaccaaacgccatgtagatcttgcccattgcggaacagtagagcggcatatgctggccaatataggcacgggttcgcagcatcccggttgtgggttccagcttataaatcaaaatagcgtgatcgtcttcgcggctggagaagttaatggtttcaccagtggcgatgttcagtgcctcaagatgcggagcggcgatatgaatgatattcagcgaagacagcgccttctgcccgacggcaataaatttggtggtcaggcgataactccctgcggcaggcgcggtggtcacatagccgcaggactgtaatccctgcaataagcgatggacggtactcttatttaaaccagccagctccgaaagatgcgccaacggacaaccgtttggatagttgctcaaaatctcaatcagcatcaacccgcgaaacagactctggcttccggctggacgctctttttcctgcgccatctcgttctctttttttcccatcacttctttccccattttgtcgcgtcctgatggtagcgcaaagtgtgccgtagttcacgatctcgacagataatttataaccaattgatttttatgtcttttgaaattcatcaatcagattgccttgttaaaaagtgatcgatatatttgaaatcaagtttcgcatattgaaattttaagccaaaaaagcgatcaaaaaaacaaggaagcctgggatgaaagtgacatttgagcagttaaaagcagcctttaatcgggtcttaatttcacgcggcgttgacagcgaaacggctgacgcctgtgcagagatgttcgcccgcaccaccgaatccggcgtttattctcacggcgttaatcgtttccctcgtttcattcaacaactggaaaacggcgatatcattcctgatgcccaacccaaacgtataaccagcctcggcgcaattgaacagtgggacgcccagcgttcgatcggtaacctgacagcgaaaaagatgatggatcgcgccattgaactggctgccgatcacggtattggtctggtggcactacgtaatgccaaccactggatgcgcggcggcagctacggctggcaggcggcggaaaaaggctatattggcatttgctggaccaactccatcgccgtaatgccgccgtggggcgcaaaagagtgtcgcataggcactaacccgctgatcgtcgccattccttccacgccgatcaccatggtcgatatgtcgatgtcgatgttctcttacggcatgttagaagttaaccgtctggcaggtcgtcagctcccggtcgatggtggctttgatgatgagggcaatttgaccaaagaacctggcgttatcgagaagaatcgccgcattttgccgatgggctactggaaaggttctggcatgtcgattgtgctggatatgatcgctactctcctttccgacggcgcatccgttgccgaagtcacccaggacaacagcgacgaatacggcatttcacaaatttttattgccattgaagtggacaagcttatcgacggtcccacccgcgatgccaagctgcaacgcatcatggattacgttactagtgccgagcgtgctgacgaaaatcaggccattcgcttacccggccatgaatttactaccctgctggccgaaaaccgccgtaacggcatcactgttgatgacagcgtgtgggccaaaatccaggcgttatgaggagataagtcatgatttttggacatatcgcgcagcccaatccgtgccgtttgcccgccgccattgaaaaggcgctcgattttctgcgcgctaccgatttcaacgccctggagccgggcgttgtcgaaatcgacggcaaaaatatttatacgcaaattatcgatttaaccacacgcgaagcggtggtaaaccgtccggaagtgcatcgtcggtatatcgatattcagtttctggcgtggggcgaagagaaaatcggcattgctattgatacgggaaataataaagtcagcgaatcactattagagcagcgcaatattattttttatcacgacagtgaacatgaatcatttatagaaatgataccgggcagctacgcaattttctttccgcaggatgttcaccgaccaggttgtattatgcaaacagcctctgagatacgaaaaattgtggttaaagtcgcattaacggcgctgaattaatcgaataatcgtctacgccagaacgcctgggtaatgttattgctctaactatattaataattcaggttgctgcacatgcgacttgaattatgacagacatagcctcaaggaatagctatgaaaaaaatactcgaagcaatactggcgattaatctcgccgtactttcctgtattgtatttataaacattattttaagatatggttttcagacaagcattttatctgttgatgaattgtcacgttatttatttgtctggttaacgtttattggcgcgattgtagcttttatggataacgcccacgttcaggtcacctttctggtggagaaactctcccccgcatggcagcgacgagtcgctctggttacccattccttaatcttatttatttgtggcgcactggcctggggcgcaacgctaaaaacaattcaggactggagcgattattcaccgatcctcggtttacccatcggcctgatgtatgccgcttgtctgcccaccagcctcgttatcgcattctttgaactgcgtcatttatatcaactcatcacgcgtagcaattctctaacgtcgccaccgcaaggagcttaatcatggctgtgctgatttttctgggctgtctgttgggtggtattgctatcggtttgcctattgcctgggcactgttgttgtgcggggcggcgttaatgttctggctggacatgtttgatgtccagatcatggcacaaacgctggtgaacggagccgatagcttctccctgctggcgattccgttctttgtgctggcgggtgaaatcatgaatgcgggcggcttgtcaaaacgcattgttgacctgccgatgaaactggtggggcataaaccaggcgggctgggctacgtcggcgtgctggcagctatgattatggcgagcctttctggttctgccgttgcggataccgccgccgttgccgctctactggtgccgatgatgcgcagcgccaactatccggtcaaccgggcggcggggctgattgcctctggcggcattatcgcgccaattattcccccttccattccgtttattatcttcggcgtttccagcggattatccatcagtaagctgtttatggcgggcattgcccctggcatgatgatgggcgcaacgctgatgcttacctggtggtggcaggccagtcgccttaatttaccccgccagcaaaaagcaacgatgcaggaaatctggcactcttttgtctccggtatctgggcgctgtttcttccagtcatcattattggcgggtttcgctccggcctgtttacccctaccgaagccggggccgttgctgctttctatgcgctgtttgtcgccacagttatttaccgtgaaatgaccttcgccacactttggcatgtactcattggcgcggcgaaaaccacctcagtggttatgtttctggtggcctcggcacaagtttccgcctggctgattaccattgctgaactgccgatgatggtttctgatttactgcaaccgttggtcgattcaccgcgtctgctgtttatcgtcattatggtggctatcctgattgtcggcatggtcatggatttaacgccgacggtattaattcttaccccggtattaatgcctttagttaaagaggcaggaatcgatccgatttatttcggtgtcatgtttatcattaactgctcaatcggcttaattacaccgcctatcggtaatgtacttaacgttatttcaggggtggcaaaactcaaattcgatgatgcagtcagaggcgttttcccttacgtcctggttttatattcattattagtcgtatttgtttttattcccgatctcatcatcctccctttgaaatggattaattaaaaggaaaatattatgaaattacgctctgtaacctacgcattattcattgctggcctggctgcattcagcacatcttctctggcggcacaatctttacgtttcggttatgaaacatcacaaaccgactcgcaacatattgcggcgaaaaaattcaatgatttattgcaggagagaaccaaaggcgagctgaaattaaaactgttcccggacagcactctcggtaacgcgcaggcgatgatcagcggcgtacgtggcggcaccatcgatatggaaatgtccggctcgaataactttgccgggttatcaccagtgatgaacttgcttgatgtccctttcctgttccgcgataccgctcacgcgcataaaacgctcgacggcaaagtcggtgatgatctgaaagcctcacttgaaggtaaaggactgaaagtactggcctactgggaaaacggctggcgcgatgtcaccaactcgcgcgcaccggttaaaacccccgccgacctgaaagggctgaaaatccgcaccaacaatagcccgatgaatatcgccgcattcaaagtctttggcgctaacccgatcccgatgccgtttgccgaagtctataccgggctggaaacccgcactatcgacgctcaggaacacccgatcaacgtcgtctggtcagcaaaatttttcgaagtgcagaagttcctttctctgacgcaccacgcctattccccgcttctggtggtgatcaacaaagcgaagtttgatggcttaagtccggagttccagcaggcgctagtttcatctgcacaagaagcgggtaactatcagcgcaaactggttgctgaagatcagcaaaaaatcatcgacggcatgaaagaagcgggcgtggaagtcatcaccgatctcgaccgcaaagcctttagcgacgcactggggaatcaggttcgcgacatgtttgttaaagatgtgccgcagggagctgatctgctgaaagccgtggatgaggtgcaataaaccatgacgcaatactggctggggttagattgtggcggtagctggctgaaagccgggctgtatgaccgcgaaggccgggaggcaggcgtgcagcgcctgccgctgtgcgcattaagcccgcagccaggctgggcagagcgcgatatggcagaactgtggcaatgctgcatggctgtcattcgcgccctgcttactcattctggtgttagcggggaacaaattgtcggtatcggcatctccgcacagggaaagggcttgtttttgctggataaaaacgacaaaccgctcgggaatgctattttgtcctcggaccgccgggcgatggaaatcgttcgtcgctggcaggaagatggcatcccggaaaaactctacccgctgacccgacaaaccttgtggaccgggcatccggtgtcgctgttacgctggctgaaagagcacgaaccagaacgctacgcgcaaattggctgcgtgatgatgacgcacgactacctgcgctggtgtttaactggcgtcaaaggctgtgaagagagcaatatttccgagtccaacctctacaacatgagtcttggggaatatgacccgtgcctcaccgactggctggggatcgctgaaatcaatcacgccctgccgcctgttgtcggatctgccgaaatctgcggggagatcaccgctcagacagccgccctgaccggtctgaaagcgggtacgcccgttgttggcggcctgtttgatgtggtttccaccgcactctgcgccgggatcgaagacgaatttaccctcaatgcggtgatggggacctgggcggtgaccagcggcataacccgcggtttacgtgacggtgaagcgcatccgtatgtctatggtcgctacgttaacgatggtgaatttatcgttcacgaagccagccctacctcttccggcaacctcgaatggtttaccgcacagtggggagaaatctcgtttgatgagatcaatcaggccgttgccagcttgccgaaggctgggggcgatctctttttcctgccgttcctgtacggcagcaacgccggactcgagatgaccagtggtttctacgggatgcaggccattcacacccgcgcgcacctgttgcaggccatctatgaaggggtggtgttcagccatatgacccacctcaaccgaatgcgcgaacgttttactgatgttcacaccctacgcgtcactggcggcccggcgcactccgatgtctggatgcaaatgctggcggacgtcagcggtctgcgtatcgagctgccgcaggtggaagaaaccggctgctttggtgcggcccttgccgcccgcgtcggcaccggggtttatcacaacttcagcgaagcccaacgtgacttgcgacacccggtgcgcaccctgctgccagatatgaccgcccatcagctttaccaaaaaaaatatcaacgttatcagcatctcattgccgcacttcagggctttcacgcccgcattaaggagcacacattatgagccgaccacttctgcaactggccctcgaccactcatcacttgaagccgcgcagcgcgacgtgacgctgttaaaagacagcgtcgatatcgtcgaagcgggcaccattctctgtttaaacgaagggcttggcgcggtgaaagccttgcgcgaacagtgcccggacaaaatcatcgttgctgactggaaggtcgccgacgctggtgaaacgctcgcgcaacaggcgtttggcgcaggcgctaactggatgaccatcatctgcgccgcgccgctcgcgacggtagaaaaaggccacgcaatggcacaacgctgcgggggtgaaattcagatagagctgttcggtaactggacgctggacgacgcccgcgactggcatcgtattggcgtgcggcaggccatttatcatcgcggtcgtgatgcacaggccagcgggcaacagtggggcgaagccgatctggcacgcatgaaggcgctttcagatatcggccttgagctttccattactggcgggattacccctgctgacctgccgctgtttaaagatatccgcgtgaaagcgtttattgccgggcgggcactggcaggcgcggcaaatccggcgcaagtggctggcgatttccatgcgcaaatcgacgctatctggggaggtgcgcgtgcgtaatcatcagttagggatttatgaaaaagcgctggcgaaagatctctcctggccggagcggctggtgctggcaaaaagctgcggttttgattttgtcgaaatgtcggtggatgaaaccgacgaacggctctcacgtcttgactggagcgccgcacaaaggacttcgctggttgccgcgatgatcgaaacaggtgttgggatcccgtcgatgtgcctgtccgcacatcgtcgctttccctttggtagccgtgacgaggcagtgcgcgaacgggcgcgggaaatcatgagtaaagcgattcgcctggcgcgcgatctcggcattcgcaccatccagctggcaggttatgacgtctattacgaagaccacgacgaaggcacccggcaacgttttgctgaagggctggcgtgggcagtcgaacaggcggcggcatcacaagtaatgctggcggtggagattatggataccgcgtttatgaactccatcagcaaatggaaaaaatgggacgagatgctcgcctcaccgtggttcaccgtctacccggacgtcggcaacctcagcgcctggggcaatgatgttcccgccgaactgaaactgggcattgaccgtatcgccgcgatccacctgaaagacacccagccagtcaccgggcaaagtcccggacagttccgcgacgtgccgtttggcgaaggctgcgtcgatttcgttggcatcttcaaaacgctgcataaactgaactatcgcggttctttcctgattgagatgtggaccgaaaaagccaaagagccggtgctggagattattcaggcgcggcgttggattgaagcgcgtatgcaggaggctggatttatatgttagagcaactgaaagccgacgtgctggcggcgaatctggcgcttcccgctcaccatctggtgacgttcacctggggcaatgtcagcgcggtagacgaaacgcggcaatggatggtaatcaaaccttccggcgtcgagtacgacgtgatgaccgccgacgatatggtggtggttgagatagccagcggtaaggtggtggaaggcagcaaaaaaccctcttccgatacaccaacgcatctggcgctctaccgtcgctatgccgaaattggcggtattgtgcatacccactcgcgccacgccaccatctggtcacaggccgggctggatctccccgcctggggcaccacccacgccgattatttttacggtgccatcccctgcacgcgacagatgaccgcagaggagattaacggcgaatatgaatatcagaccggcgaagtgatcattgaaaccttcgaagaacgtggcaggagtccggcacaaatcccggcggtgctggtgcattctcacggcccgttcgcatggggtaaaaacgccgccgatgccgtgcataacgccgtagtactcgaagaatgcgcctatatgggtctattctcgcgccagcttgcgccgcagctccctgcgatgcaaaacgaactgctggataagcactacctgcgtaagcatggggccaatgcctattacgggcagtaatccctcacgccggggcttcatcgccccggcactacgaattgatatgttccttgctgtaacgccgcttccacgctgctggcgttaaaccagtatgtttctgaaaaatctgccggaaatagccaacgtcattaaaccgtattgcatggagcaggccgacaacgtcgagtcactgcataacctgttgctgcccgccgatgcgccatttacgacatttgaaggcaagggattgttcagccataagatcctgattcagacgccaggttcccggtatgaacagagcaatccagagcaacaacctttgtggcattacgacggagcaccagccgcaccgacatccaccggtgaattaaaaacgccagctcaccccggtgacaaaggtaaaactctcattacgatcaatcatcgggctgtcggtaatctcttccggcagctcgctgtatcctgcgctcgccatcaatacgacgtgctctcctatcgggtattttgccgtcaggctgacatagggcacccaggcatcctgcgcggaataacttgccagaccgctacgacgggactcactctctgaaatgccatagtaatagtcactgaaattctcgtcataatagagaacgcccagcgcaggtgtcagcgacagacgacctatctgcattttgtggaataccgatagctcccccacccagccgttgctgttatccagaacgtccgcagctgcagaggctttcacggttccccaacgctcgtggtgataccaggcaacccccgccatagccgtactatcacgcttatcaagctgttgcatggcataatcgtcattatcggtagggtcaaattccagcggcatccaggatgcggtcaggctaagttcatttttttcactttgcgacagaataaaacctaacgtggtctgacgaacataaaaagtatcaccttcataactaatcagcggaattgccttcgtattttcattataaccgcgataaggcgattcattataagccgcaccagcaccaatggataattcagaagcagttgcgcttgccataaaaggcaacgcaaataacgccacaatattgcgattaattaacatgtccggtattccattttaaaataagataaaaaagagtcggcataataatgcttacaatttctccggtgcaagattcatatttatatagtaatatataaaattatatataattgggctgttgcgatgacaaaattacaacttaagtaccgggagttaaaaattatctcggtaatcgctgccagtgaaaatatcagccatgccgcgactgtacttggcatcgcacaggccaacgtcagcaaatatcttgctgattttgaatcaaaagtgggtttaaaagtctttgaccgaaccacccggcagctgatgctcacaccttttggcaccgcgctgttaccgtacatcaacgacatgctggacagaaacgagcaacttaataattttattgcagattataagcatgagaaacgtggtcgggtcaccatctacgccccaaccggcataattacctatttatccaaacatgtaatcgataaaattaaagatatcggtgatatcaccttatcgctaaaaacctgcaatcttgagcgtaatgccttttatgaaggcgtcgaatttcctgatgattgtgatgttttaatcagctacgctccaccaaaagatgaatcgctggttgccagttttattacccaatatgccgtaaccgcttatgccagccagcgctatcttgagaaacatcccattagccgtcctgacgaactcgaacatcactcctgtattttgatcgactcgatgatgatcgacgacgcgaatatctggcgcttcaacgtcgccgggagtaaagaggtgcgggattatcgcgtgaagggaaattacgtttgcgacaacacgcaatctgcgctggagctggcacgaaatcacctggggattgtgtttgcgccagacaaaagtgtgcagagcgacctgcaagacggcacgctggtgccctgctttcagcaaccctatgaatggtggctggatctggtggctatcttccgtaaacgggaataccagccctggcgggtccagtatgtgctggatgaaatgctgcgtgaaattcgccaccagcttgctcagtcgcagcaactgcggcctgaacaagcggcggaaagcgaagattaatgatcgagataaaggtaatgcacccagctggtcatgcgtaatagcactttgcgcatcaccgagacatggctgaaatgatcagagtaaaccgccacctgggcgtaaataccgtctggtaaagcgctcaaatcagtgtgctcatccagttcaatggtcgcgataacgccatctgaacccggcgctgtgtttaacgtctgtaaggtgccggtcgactgataagctccgccgggaacggctggactaatggctgccagcttaccgctgaataccttacctggcagagcattaaacaccacttccgcatcgtcgccaggagccagtcgcagcaaggagttctgacggaactgcgccacgatttgtcgtttctgatcgggtataaacaccatcaccggacgtagcggcagcgacgcggcataggtacccggacgaatcagtacctgggtcacataaccatcgctcggcgcacgcactatcgtctgctcaaggttatattttgcttccgcgagctgtgctttcaggctggcgatttgagaatgttcacccaacaccaggctatccagctggctctggatctgtttttgttccgccgccgatgacttcacggaggcttcctgcgccagataattttgccgcgccacatcgatatcgcgttctgaaaacgggtttactttcgcctggctgccacgtgcgtaacgctgatactctttagcgaatttatcccgcgtggcctttgcctgctgagtattcgccgccatctcatctaactctgcgcccaacgcccgctgtttatgttctgcggtaacgatatccgccatcagccgatccacccgcgcctgataacgcgtcgggtccagtcgaaatagcacctcaccttttttaatcagcgtatttttcttatccgtcacttcaatcaccacaccagtcacctgtgggacaacaggaatagaaataaccgctttttgcgctttaaaggtatacggatggttatagttcattaacagaattagaccgctgacaataaatattccacccagggccgctgtgggaatggtccatttatttacgggaattttgaagatcttaaacattgcccatgcaaaagccacataggtcaaaataatcagtaaatccataagtattactcggcagaagaggatttgatgtcggcgagctgtttctccagcccggcaatgcgctgttgcagttgcataacggatgaatcatggctttgcattccccatccccgctccgggcggtaaagcgtggcccaaatccacaaaaacggccagataacatgtaacgtaaaaagactcacccaaccagcaacatgaatggcgtcggcatgaggatgattacgttttttggcaatcaggtagggaatatcatgtaaaataatgatcccatagaagatcaccagaaatacaaaaataagcactcccagtgcaaaatagtccaggaacatatttccctcaaagaatataaaaaagaacaattaacgcatattatgaaatgccatgatgcagtgcaatttccttatttatataacgacatattgttttttatatactttcttaaatgtgctgtctggtttttcaacaggacgaggtttatcatattgaaatagtggaactattggccaaactaatgaataactccagtaaaacatccacagtacagattaagcgtattaaaccttcaattatctaccgtttattgctgattggcctcggatcaccaatggtgatttacggcctggttcgcccgctcaccatcgaaacgcgagattaaactcctgacaaaacacgccccagaaacgtacttctgttggcgtagtctgggttattgcgcacgtaggtttaaaacgtaaattgtaacaacgtgcgctttgtttatgccggatgcggcgtgtacgccttatccggcctacggtcaggttcccgtaggcatgataagacgcgtaagcgtcgcatcaggcaatgaatacccaatgcgaccagcttcttatatcagaacagccccaacggtttatccgagtagctcaccagcaggcacttggtttgctggtaatgctccagcatcatcttgtgggtttcgcgaccgatacctgattgtttgtagccaccaaacgccgcatgtgccgggtaagcgtgataacagttggtccacacgcgcccagcctgtatgccgcgccccatcttataggccagattaccgttgcggctccagacgcccgcgcccaggccatattgcgtatcgttcgccagctccagcgcttcttccatcgttttgaaggtggtcaccgccagcaccgggccaaaaatctcctcctggaacacccgcatattgttctgaccaaacagaatcgtcggttcgaggtagtagccgtctttcagttcaccttccagcagcttgcgccgcccgcctgtgagcacgtcagcgccctcttttttaccgatatcaatgtagttgaggatggtttccagttgcccgtgagaaacctgcgcgcccatttgcgtcacgctgtcgagcgggttaccgctacgaatgctttcgacacggcggatggcgcgttccataaagcgttcgtagatagattcctgcactaaagcacgactcggacaggtgcaaacttcgccctggttaaaggcaaacagtgcaaagccttccagcgctttatcgaaaaaggcatcttcttcatccatcacatcagcaaagaagatatttggcgacttaccgcccaactccagcgtcaccggaataatgttttgcgttgcgtattgcataatttgttggcccacttccgttgagccggtaaacgccactttggcgatgcgtttcgaggtcgccagatattcgccaattaccccacctgcgccattgaccacgttcaccacgcccggcggcagtaaatcaccgacaatttccattagcagcagtacagaaagcggggtaagacgtgcgggtttcagcaccacacagttgcccgccgccagcgcgggagccattttccagctcgccatcagcagcgggaagttccacgggataatctgccccaccacgcctaacggttcatggaaatgataggccacggtttcgctatcaacttcactgatcccaccttcctgcgcccgaatacacgaggcgaaatagcggaaatggtcaatcgccagcggtacatccgcagcactggtttcgcgaatgggtttgccgttatcccaggtttcagctgtcgctaacagctcgaggttttgttccattcgatcggcaatcttaaacagaatcgccgcacgatcctgcaccgaggtgtgcgcccatttatctttcactttgtgcgcagcatccagcgccagatcgatgtctcgtttgcccgaagacgccacttcgcacagcagctgcccggtcaccggcgtcagattctggtaatactcgccgtcggcaggggctacccattcgccgccaataaagttgtcatagcgggcttttaacttgagggggaaaccatactcgccgggcttaatctgtgctgaagggggattattggtcatgatcgtctccttgcggtgtgaggtataacaagggtagacgtgactggcgaaatcttcgccagtcggtaacagctttacgacagctatcacgaatttacgggcaagggttacagagatagttgaaaaagcggctaacaatttgccagccgttgtggaaatgatgattacatcgctgcgcgataaatcgccacaatttcttcgtgagttgcctggatcgggttagtaaagccacaggcatctttcagggcattagtcgccaataccgcgaaatcttcttctttcacgttcaggtcgcgtaggcctgccgggatatccactttcttcgccagttcacggatggcgttaatgcaggcttcagcaccttccgcgtcgtttttacctgtcacgttcacgcccattgcagcggcacagtcacgcagacgtgcagcggcgactttgctgttgaatacctgaacgtgcggcagcaaaacggcgttacatacaccgtgtggcaggttgtagaaaccgcccagctggtgcgccatcgcatgaacataacccagagaagcattattgaacgccataccggcgaggaactgggcataagccattgcttcacgcgctttcgcattactgccatcttcaacggctaacggcaggttttcggcaatcatggtcacggctttcagtgcacaagcgtcagtgatcggcgtggcggcaatagaaacatatgcttcgatagcgtgcgttaaggcatccatacccgttgcggcggtcagtgacttcggcataccaatcatcagagaggagtcattgacagaaagcagcggagtgacatgtttatcaacaatcgccattttgatatgacgcgcttcgtcagtgatgatgcagaaacgggtcatttcagaggccgtacccgccgtggtattgatggcgatcatcggcagctgcggttttgcagagcggtcaacgccttcgtaatcgcgaatatcgccgccattggctgccaccagcgcaataccttttgcgcagtcgtgtggagaaccaccgcctaaggagatcacgctatcgcaattattctctttaagtaatttcaaacctgcggcgacgttttccgtggtggggttaggttgggtgccatcataaataacgctaaaaatattgcgttcttccagtgctttttgcacatcgcccgccatacctaatttcgttaacatattgtcagtgacaattaaggtacgggtaaatccataatctgccatcatattcattgcatcagtcaatgaatcagcgccgatgacattcacagaaggaataaagaacgttgaagctgccataacacactcctgaaagtgtaaaaaagggcgggcagcttactgaggattttcattcgaaaatatgatcagtattattgattatcaaaattaatctaataaaaagcacattgtattcattaaacaatgtgctttttttaaattcataagaattttgtattaatttattttaaaacttaattaatcatttccttatttttccggaaataataatgcgtcgcgcaataaatgatcatttccacgacgacgcgtaaagccaatgcggtcaaaatattccagaatctgaattgccagctttcggcctacgcctaagcgatcgcggaaatccgccgcgcaggttgaaccacactcctgatcgagatcgcggatcatattggcaaactcgacaatccgatcgttacggtaataacgatctttaacgatcgcggtaattattccttgctgcgccgcctggcgtagagtcaggcgcattgcctgctcgtcggttcccgtctcttttgccaggtcacgcacccaccacggttcgtcaccaaacagtggctctgctttttgccagatggcctgctgctcttcgctgaagcccgctttgtgatctggcagatgcagccagccgtgatggctgtggatgtcgccgctttcgcgcatcttttcaatcagcaacagtaccagcgcttcatcttccattggcaacgccatacgtcgcagacgttcgcgcccagggccaggttcatcgcgatgttgctcatgataagtcgctaatgtgtcgagaattttccgctgccagcgggcggcaaccggcgcattcaacaagctataaccagcctgaatataaccaggctgttgcagcaattcgcgcatcccttcgccgttgagctggcgcgcccaggcgaaatccgcaaggttaaccgcgccgcgttccagatgaacagataacgcatcggcatcgctctgcgcccgtgcaagagacgccagccattgcagatattccggcttacgtttaccgcgacgcggcgggttaagcatcacgacgcgcgctccggccagcgtgttgcgggcagagatatcgcgcaataccaggcggtcgttatctgccagccataacggggtgtcgaagaccagttcagcaaggttatcttccagcagtgaaacgcgtcccgtgacgtggctggcggcgtggtgaatatgcagcggctgccactgggtcagcggtgtatgggtttgaagctcgacaatcacccgtgtgaacggctctggcggcacatcggcaagcagccagtcgccacggttaatctgctctttttccgcatcacccgcgatgttaagcgcgatacgctgcccggcattggcggtttctgttggctggttttgcgcatgcagcgcacgtacacgcatcggtttatttacaccagtcagccagagtgaatcgcctaccttcacttccccgcttaacgccgtaccggtgacgaccagcccggcaccttttacggtaaatgcgcggtcaatcgcgaggcggaaactatgttggctggcgtgctcgcgttccggcaactgaagcagatgctcgcgcagggcatccattccccgaccttcggttgctgcggtgataaacagttttgcctcagcaaaaccgtattcccgcagaacctcctttacctggcgttcaacctcatcaacacgcgcttcgtccacgcgatcggctttggtcagcgccactgtcagcatcgggttaccggtcagctgcaaaatcgccagatgctcacgggtctgtgccatcacgccgtcatcgcacgccaccaccaacagcgcgtgatcgataccaccaacgcccgccagcatgttggaaagaaacttttcatgaccgggaacgtcgataaaaccaggcacgcgaccatccggctgcggccagtaggcatagccgagatcgatggtcatgccgcgctttttttcttccggcagacggtcagcatttacgccagtaatcgcctgcaataaggttgttttgccgtggtcaacgtgtccggcagtcgcaataatcatttcaacaacatctccaaaaaccgttgctcatcttcaaggcagcgtaaatccagccacaatcgtccgtcataaatacgaccaatcaccggcactggcaattcacgccagcgggcggctaatgactcaaggtggctaccgcgtccatcatggggtgtaaacgttaatgccgcgctcggcaggcgatcaaccggcagcgaaccactgccaatctgcgaaagacatggcataacctgtaccgcaaactccgcgccgtaatgtgcggcaaggggggcctgtaaacgttgtgcctggatttgaatgacctctgcgctgcgggtaagcaggcgcagggtcggtaatttttcactcagagcttcagggtgtaaataaagacgcaacgtggcttccagcgccgcgagggtcattttatccgcgcgtaatgcacgcttcagcgggtggctttgcaggcgggcgatcatctcttttttaccaacaataattcctgcctgcggcccgcctaacaacttgtcgccggagaaactcaccagactgacgcccgccgcaatcaactcctgcggcattggctctttcggcaaaccgtactggctaagatcgaccagcgagccactgcctaaatcagtcactacgggaacatccagctctttgccgagcgccaccagttccgcttcatctatcgctttggtgaacccctgaatgctgtagttactggtatgtactttcatcaacagtgcggtattttcattcaccgcctgacgataatcattcgcgtgcgtgcggttggtggtccctacttcgtgtagggtgcagcctgcctgacgcataacatcgggaatacgaaacgcgccgccaatctccaccagttcgccgcgagataccaccacctcttttccgctggcagtggccgccaacatcaataacaccgccgccgcattgttattgacgatacaggcatcttccgcccccgtaatacggcacagcagctgcgccagcgcccgatcgcgatgtccgcgtccggcgtcgtccagatcatactcgagggtcactggcgaacgcatagcctgcgcaacggcttccaccgcggcttccgcctgtaaagctcgcccaaggttggtatgcagcacggttcccgtcaggttgatcaccggacgcagcgcgctctgcgcttctttcgtcaaccgggcatcgacttcttgcgcccagttttcacaccacgcaggcagcgtctggctgccacgaatcacttctcgcgcttcgtcgagcatctgacgcaacaattccaccacgcgggtgtgaccataagtatcacgcaaagaaaggaaggagctatcgcgcaataagcgatcaatagccggaagttgactatagagggaacgcgtttcggttgtcataggaaacctggctgatcaaggccctctcacacggagaagggcgtttaacataaccacggattgtaacgtgagatgggtcaggaggacatatcgcgcatcaagcctttggcggttcggtgcgagcaaaactttcgcggctaaacaggttttcgaccagtttgactaagtgtgggcggtcgacacaccaacctggcgcaacgcggcggaaattgagatatccgacggcacaggcaatggcgatagtcgccagattgaccgtatcggttttgagtgtgccatcgaccagatatccttccagcacatccagactgcggttgattttctcccgctggcgtaacaattcatcttcagactgctgcgccgctggacgcgcctgttcacgcaccgataccagcccggcatccataatgccatccgccagtgcctcaattttgcgcacccgcaacgactccagcggatcgcgcggcaacatcgccggagcgacattcattaattcaatatattcagcgatgatcggcgaatcaaaccagcattcgccctcttcggtcaccagcaccggcacttttcctaacgggttaaattgcgccacgccgttgtccgcgttatagggcagttcattaataaattcgaaagttatgcccttttctaacaacagaatagaaagtttgcgtacaaacgggctggtgtagctaccgacgagtttcatgccgagtcctttgtgcgaggaaaaatatcagtatggcctggtgatgggaaaaagggcagaaaatgttgatggtttgttacttccaaataaatcacatatttatcatggtgatataaatattttcctaattatttcactctgatggatatctcacttcaggctttcttataaatctgtagggtttcgcctgtcagcagacaaataacccgataaaacaaggatgagaaatgagcggaaaaccggcagcgcgtcagggcgacatgacgcagtatggcggtagcattgttcagggttcagccggggtgcgcattggtgcccccaccggcgtggcctgttcggtgtgccccggcggagtgacgtccggccatccggtcaatcccctgctcggtgcaaaggtccttcccggtgaaaccgacatcgccctgcccggcccgctgccgttcatcctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggttggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgcctggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccacgcggcgaactggcggtggtgtatgaccgtagtggcaaacaggtgcgcagctttacttacgatgataaataccggggccggatggtggcgcaccgtcacacgggccggccggaaatccgttaccgttacgacagcgacgggcgggtgacagaacagctaaacccggcaggcttaagctacacgtatcagtatgagaaagaccgcatcaccatcaccgacagcctggaccgccgtgaagtgctgcacacgcagggcgaagccgggctgaagcgggtggtgaaaaaggaacacgcggacggcagcgtcacgcagagtcagtttgacgccgtgggcaggctcagggcacagacggatgccgcaggcaggacaacagagtacagcccggatgtggtgacgggcctcatcacgcgcataaccacgccggatggcagggcatcggcgttttactataaccaccacaaccagttaacgtcagccaccgggcctgacgggctggaattgcgccgggaatatgatgaattgggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcaccgactgttccggttatgtaacccgttatgaccatgaccgcttcgggcagatgacggcggtgcaccgcgaggaagggctgagtcagtaccgcgcatacgacagccgtggacagttaattgccgtgaaagacacgcagggccatgaaacgcggtatgaatacaacatcgccggtgacctgaccgccgtcattgccccggacggcagcagaaacgggacacagtacgatgcgtggggaaaggccgtccgtaccacgcagggcgggctaacgcgcagtatggaatacgatgctgccggacgggtcatccgcctgaccagtgaaaacggcagccacaccaccttccgttacgatgtacttgaccggctgatacaggaaaccggctttgacggccgcacacagcgttatcaccacgacctgaccggcaaacttatccgcagcgaggatgagggtctggtcacccactggcactatgacgaagcagaccgcctcacgcaccgcaccgtgaagggtgaaaccgcagagcggtggcagtatgacgaacgtggctggctgacagacatcagccatatcagcgaagggcaccgggtggcggtgcattacaggtatgatgagaaaggccggctgaccggtgagcgtcagacggtgcatcacccgcagacggaagcactgctctggcagcatgagaccagacatgcgtacaacgcgcaggggctggcgaaccgctgtataccggacagcctgcccgccgtggaatggctgacctacggcagcggttacctggcaggcatgaaactcggcgacacaccgctggtggagtacacccgcgaccgcctgcaccgggaaacgctgcgcagcttcggccgttatgaactcaccaccgcttatacccctgccgggcagttacagagccagcacctgaacagcctgctgtctgaccgcgattacacctggaacgacaacggcgaactcatccgcatcagcagcccgcgccagacccggagttacagctacagcaccaccggcaggctgaccggcgttcacaccaccgcagcgaatctggatatccgcatcccgtatgccacagacccggcaggtaaccgcctgcccgacccggagctgcacccggacagcaccctcagcatgtggccggataaccgtatcgcccgtgacgcgcactatctttaccggtatgaccgtcacggcaggctgacagagaaaaccgacctcatcccggaaggggttatccgcacggatgatgagcggactcaccggtaccattacgacagtcagcaccggctggtgcactacacgcggacacaatatgaagagccgctggtcgaaagtcgctatctttacgacccgctgggccgcagggtggcaaaacgggtgtggcggcgtgaacgggacctgacgggctggatgtcgctgtcacggaaaccgcaagtgacctggtacggctgggacggcgaccggctgaccacaatacagaacgacagaacccgcatccagacgatttatcagccggggagcttcacgccactcatcagagttgaaaccgccaccggtgagctggcgaaaacgcagcgccgcagcctggcggatgcgcttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgaccgtggagcagatgcaaaaccagatggacccggtgtacacgccggcgcgaaaaatccacctgtaccactgcgaccatcgcggcctgccgctggcccttatcagcaaggaagggacaacagaatggtgcgcagaatacgatgaatggggcaacctgctgaatgaagagaacccgcatcagctgcagcagcttatccgcctgccggggcagcagtatgatgaggagtccggcctgtattacaaccgccaccgctattatgacccgctgcaggggcggtatatcactcaggatccgattgggctgaaggggggatggaatttttatcagtatccgttgaatccagttacgaatacagatcctctggggttagaagtttttcctagaccattccccttgccaattccatggcccaaaagccctgcacagcagcaagcagatgataatgctgcaaaagcattgacaaaatggtggaacgatacagcatcacaaagaatatttgactctctaatattgaataatccgggactagcattagatataacaatgatagcttctcgtggaaatgttgcagacacagggataactgatcgtgtcaatgacataataaatgacagattctggagtgatgggaaaaaacccgacagatgtgacgtacttcaggaactaattgattgtggtgatattagtgctaaagatgcaaaaagcacacagaaagcctggaattgtcgtcactccagacagtcaaacgataaaaaaagatagcccttgtggaggttcctgcaatgtcaaatacataccagaaaagaaaggcaagtaaagagtatggtttatataatcaatgtaagaaactaaatgatgatgaattatttcgcttacttgatgatcacaattccttgaaaaggatttcatctgccagagtattacagttaagaggtgggcaagacgctgttagattggcaattgagttctgctctgataaaaattatatccgtagagatatcggagcatttatactcgggcaaataaaaatttgcaaaaaatgcgaagataatgtttttaatattttgaacaatatggcattgaatgataagagcgcttgcgttcgagctacggcaatcgagtcaacggctcagcgatgcaagaaaaacccaatttattcacctaaaatagtagaacaatctcaaattactgcttttgataaatcgactaatgtcagacgtgctacagcatttgctatttctgttatcaatgataaagcaacaattccactattgattaatctgttaaaagatccaaatggagatgtcagaaactgggccgcatttgcaataaatatcaataaatatgataatagtgatattagggattgttttgtggagatgcttcaggataaaaatgaggaagtccgtattgaagcaataatcggactttcctacagaaaagataaaagggttttatctgttttatgcgatgagttaaaaaaaaatactgtttatgatgatatcattgaagctgcgggtgaattaggtgataaaacgctacttcctgttttagatactatgttgtacaagtttgatgacaatgaaattataacttccgctattgataagctgaagcgttcatagcgtgagttgcctatgcacagtgggggattcccgccggcacggtgcagatgctcgaccggctggaaagtgaaatcctggctgaccgggtgagtgaggaaagccgccgctggctggcatcgtgcggcctgaccgtggagcagatgaaaaaccagatggacccggtgtacacgccggcgcgaaaaatccacctgtaccactgcgaccatcgcggcctgccgctggcgctcatcagcacggaaggggcaacagcgtggtgcgcagaatatgatgaatggggcaacctgctgagtgatgagaacccgcatcatctgcagcagctcattcgcctgccgggtcagcagtatgatgaggagtccggcctgtattacaaccgccaccgctattatgacccgctgctggggcggtatatcactcaggatccgattggactgaaggggggatggaatttttatcagtatccgttgaatccggtcataaatgtagatccgcaaggtttggttgatataaatttataccccgaaagtgatcttatccattctgtagctgatgagattaatatcccaggcgttttcacaatcggggggcatggtacccccacatctattgaatccgcaacgcgcagtatcatgacagctaaagatctagcatatctaattaaatttgatgggaattataaagatgggatgacagtttggttattttcttgtaatacaggtaaaggacaaaattcatttgctagctaattagctaaagagttacatacaaatgtaataggacctgacacgctatggacgtggtgggggcgaggaactaatggtaagttaaaaatggatacagtgctaacagcaccaacgaaccttaattcaaataaggatctaatggctataacaacaaaagaccttggtaattggataacatatgggccatctgggcaccccatttctaatatgcaaggtacgccagaaaaacccagtgatataagataggttgtagatgtatgaaagcatgcttgttactatttttttatttctcttttatttgtcaattgcatggtgctgatgtgaaaataaaacaaaacgaaagtatgatggggtctacagcaatgacctatgatttaagtgaagaaaagttgatgaaactgaagtataaatcacaacatggtgattcagaggcatcatttcgactatatcaatattactgctttactaaaaataacatttacaaacaattgcgattcttggaaagatcagcatctcaggggaatgttacagcgcagtttaattatggggtctttttatcagatacaaatccaacattatcagaatattataatttgaatagagctatttattggatggaattcgctgtaaataacggtaatattgatgcaaagagcaaacttcaagagctcaaaaagctaaagcgaatggatagaaggaagaataaggagaatccgtaaaagcaatagttcatcagactgccgcagcagtagtatgatgatgaatcagggctgtactataactattatcggtaacattaaccgcagcaggggcggtataacactcaggctccgattgggctggaaggtaggtggaatttttatcagtatccgttgaacccgatttctggaatcgatccccttgggattagccacctgtttatacagcataactttaggtatgctttcgtgtgtttcagatataccatgtgatgataatttttatgatgtgcttagtattccagtcgcttctggtaataatatgcaatgtaaaaataatccccgttgtacacatttataaatagatggccaatacctcaaggcctatggagttggaatgttaatgacccgggagcaagcaatagaaaacctgacggcatacgattagtaccgtcagttaatacaggaacttataatcgcaatggattttcaatacatagttgtttaaacgcttttggtccgtctttaggacctcgattctgttccgagggttgtataactggtttatctaatgacatgcaaaaattaaatgagttaatattttcagagccagatagcacattaacagttacggactaaaaaatatggcaaggttattaacaattgtatttttttctctatttctgcgagtgcagttactgcaagacaatttcagagagagttagatttggcagacaaagcaatattatgggcactaatatcagccagtactaaagagggacgaaaagcgtgttcactaagctattttgcctgtaaggccgcagaggctgaactcggactggcatatatggctgcgaatgataacaaggaatttctcacatccttatctaatataatgaggtacaaaatagatgctggactttccgaatcctatacatgctatttattaagtaagggaaagatcataagaccatatctgaaaaatctaaatccactccaacttgccgctgattgcattgaaacagtaaataaaataaaagataagaataaaaaaaatcattgatataaattcagttaatatttgtagtgatgataaaaatataaaattgagagttaatagtactattatggccattgatgattctataaagtgcatcgatgaatgataacttaattttatttaaaaatatattaataactcactctccaggagtttttttaacttagttttataatgaatacgataattaaaagtgaagaagaaaatagttgtatacatatattccatgaccctacattgtgatctatagattaaatattttttaaatgtgactgtcatccttcagataataaagccatcatcgcaatagatggaaaagcactcctgctcttttttgattagagccgtcgcaggaggaacaactcatatcatcattgcgatctcgacgatgtatagtctcatcctgcggcagaacaagacggataaaaaatccaatgagagcacactcatccagaacttattaacataatgaatattaaagaaaaatcatcgaagctaatgaagtaatatgcaaaaataattagtccttacaaggagcaaagttccataatctcccccctccccctcaatgatccaaataaagataatgcatccagctggtcattcttagcagcactttccgcatcaccgaaacatggctgaaatggtcggagtaaaccgccacctgggcgtagatgccgtcgggtaaggcatcgatatcatcgttagggtccagttcaatggttcccagcacaccgtccgtgccgggcacgaccgttaatgattgcaataccccctgcgcctgataagaaccgcctggcacgacaggtaaaatactagtcagtttgccgtgaaacacctgcccaggtagcgcgttaaacaccacttccgcatcatcgccaggtttcagacgtaacagcgagttttgccgaaattgggcgacaatttgccgtttttgctcggggatgaagaccatcaccggacgcagcggcaaggcagctgcgtatgtacctgggcggatcagtacctgagtaacgtagccattgctcggcgcgcgaatgacagtctgctcaaggttatattttgcttcagtaagttgcgctcttaagctcacaatctgcgattgctcgccgttaaccatactgtcgagctggctctggatctgcgcctgctccgccaccgagcctttcaccagcgcatcctgcgcgaggaaattttgccgcgcatcgtcgatgtcacgttccgagaacggattcaccgccgcctggctgcctttcaagtaacgttgataatttttaaacagacggtcgcgctccgctgaaacctgggtggtgttggcctgcgcttcagtgagctgcgcacgcagcgtctttatattatgcgtcgccgtcatcaggtcagcctgaagtctgtcaactcgcgcctggtaacgaaccgggtcgagcttaaaaagcacctcgcccttttgaataagctgattattcttgtcagtgacttcagtaacaattcccgtcacctgtggcgtgatagggatcgctatcactgccttttgcgcggtaaaagtgtaagggtggttgtagttcatcaacaaaatcaaaccactcaccagaaacacgcctcccagcgccgccgtcgccagcgtccactgatttaccggaatgcggaagattttaaagaccgcccacgccagcgccacgtaagttaaaacaatcaatagatccataattagatctccgggaacgtggaatagtcagtctttttctcggcggcgagttgatgctccagccgggaaattcggtcagaaagtgcggcgatttccgggtcagtcgctttctcctgcgacgcaacatgtgactgcataccccagccacgctccggttgatagagcgtcgcccagatccacagaaacggccagataacatgcagagtaaacaggctcacccagcccgccgtatgaatagcgtcggcatggggatggttgcgctttttggcaatcagataagggatgtcatgtatcgcgatgattccataaaaaatcaccagaaagacgaagatcagcactcccaacgcgaaatagtttagaaacatatctgcctcggattcacgtttatcagtgttgtttttgggctggcagccagaagggagtcaggctgatattttgacaataatccgggttcgcgattctcgccataacaccaaagaataatttttagaggtgatgagttgcttagttacataacgattgtatgacgaaggcataacatgctgtagatcacatcaggtgaacgccgtaagaaaatatcttgtgattcagatcacaaagattcaacaaaccatcaaaacaaaaatgtgacactactcacatttaaatgccatttttagcgaaaatcgccgccttgttgcttttttacacaagcgttttgtgatgaacgtcacgtcaattacctctctaccccctatatttatgtgattgatatcacacaaaaggccgtcgactggacagttaaccgattcagtgccagatttcgcagtatctacaaggtccggctacctctgccgccacattaacaaaaaacctcgggcttccagcctgcgcgacagcaaacataagaaggggtgtttttatgtcatccgatattaagatcaaagtgcaaagctttggtcgtttcctcagcaacatggtgatgccaaatatcggcgcgtttatcgcgtggggtatcatcaccgcgttatttattccaacagggtggttaccgaacgagacgctggcgaagctggtcgggccgatgatcacttatctcctgccgctgctgatcggttataccggtggtaagctggtaggcggcgaacgtggcggcgtagtcggtgccatcaccaccatgggcgttatcgtcggcgcagacatgccgatgttcctcggttctatgattgcaggtccgctgggcggctggtgcattaagcacttcgaccgctgggtagacggtaagatcaaatccggttttgagatgctggtgaataacttctccgcaggcatcatcgggatgatcctcgctattctggcattcctcggcattggcccgattgttgaagccctgtccaaaatgctggctgcgggcgttaacttcatggttgtccatgacatgctgccgctggcgtctatctttgttgaaccggcgaaaatcctgttcctcaacaacgccattaaccacggtatcttctcgccgctgggtattcagcagtcccatgaactgggtaaatcaatcttcttcctgattgaagctaacccaggtccaggtatgggcgtgctgctggcgtacatgttctttggtcgtggtagcgctaaacagtctgcgggcggtgcggcaatcatccacttcctggggggtatccacgaaatctacttcccgtatgtgctgatgaatccgcgtctgatcctcgcagtcatcctcggcggtatgactggcgtgttcacgctgactatcctgggcggtggtctggtttctccggcatctccgggttctatccttgctgtactggcgatgacaccaaaaggtgcttacttcgctaacatcgcgggtgtgtgtgcggcgatggctgtctccttcgttgtctctgctattttgctgaaaaccagcaaagtgaaagaagaagatgatattgaagcagcaactcgtcgtatgcaggacatgaaagctgagtctaaaggcgcatctccgctgtctgctggcgatgtgactaacgacctgagccacgtacgtaaaatcatcgttgcctgtgacgccggtatgggttccagtgcgatgggcgcaggcgttctgcgtaagaaaattcaggatgcaggtctgtcgcagatttctgttactaacagcgcgatcaacaacctgccgccagatgtggacctcgtcatcactcaccgtgacctgaccgaacgcgctatgcgccaggttccgcaggcacagcatatttcgctgaccaacttcctcgacagcggcctgtacaccagcctgaccgaacgtctggttgctgcccaacgccacacggcaaacgaagagaaagtaaaagacagcctgaaagacagctttgacgattccagtgctaacctgttcaagctaggcgcggagaacatcttcctcggtcgcaaagcggcaaccaaagaagaagcgattcgttttgctggcgagcagctggtgaaaggcggttacgttgagccggaatacgttcaggcgatgctggatcgtgaaaaactgaccccgacttatctgggtgagtctatcgcggtgccacacggtacggttgaagcgaaagatcgcgtactgaaaacgggcgtcgtgttctgccagtacccggaaggcgtgcgcttcggtgaagaagaagatgacattgcccgtctggtgattggtattgctgcccgtaacaacgagcacattcaggttatcaccagcctgaccaatgcactggatgatgagtccgtcatcgagcgtctggcacacaccaccagcgtggatgaagtgctggaactgctggcaggtcgtaagtaatccaatcccaccctctccacatggagaaggtggggttaattgcctgatgcgctacgcttatcaggcctacaggatgcatcacaatttgttgaatttgcacgttcttgtaggccggataaggcgcttacgccgcatccggcgctgcccctctcctcacggagagggtttgggtgagggaaaagcctcaccccagccctctcgggtaaaaacattgatgaaggttaatactatgaaagcattacattttggcgcaggtaatatcggtcgtggctttatcggtaaactgctggcagacgcgggtatccaactgacgtttgccgatgtcaatcaggtggtacttgatgccctgaatgcccgtcatagctatcaggtacatgtggttggtgaaaccgagcaggtagataccgtttccggcgtcaatgctgtcagcagcattggtgatgatgtcgttgatctgattgctcaggttgatttagtcactaccgccgttggcccggttgtgctggaacgtattgctccggcaatcgccaaagggcaggtgaaacgtaaagaacaaggtaatgaatccccgctgaacatcatcgcctgtgaaaacatggtacgcggtaccacgcagctgaaaggccatgtgatgaacgccctgccggaagacgccaaagcgtgggtagaagaacacgttggctttgtcgattccgccgttgaccgcatcgtaccgccttcggcttcggcaactaacgatccgctggaagtgacggtagaaaccttcagcgaatggattgtcgataaaacgcagttcaaaggcgcactgccgaacatcccaggcatggagttaaccgacaacctgatggcatttgtcgaacgtaaactcttcaccctgaacacgggtcatgctataaccgcgtacctcggaaaactggccggtcatcagaccattcgtgacgcgattctcgacgagaaaatccgcgcggtggtaaaaggtgcgatggaagaaagtggtgcagtattgatcaagcgctacggctttgacgctgacaagcatgcggcgtacatccagaaaattctcggccgttttgagaacccgtatctgaaagatgatgtagagcgcgtaggccgtcagccactgcgtaaactgagtgctggcgaccgtctgatcaagccactgctcggtacgctggaatatggtctgccacataaaaacctgattgaaggtattgccgctgcaatgcacttccgcagtgaagatgatccgcaggctcaggaactggcagcactgatcgctgacaaaggtccgcaggcggcgctggcacagatttccggtcttgatgccaacagcgaggttgtatccgaggcggtaaccgcttataaagcaatgcaataatggtggaccaggcgcaggacaccctgcgcccgaataacagattgtcagatatgcaggcaacaatggaacaaacccaggcctttgaaaaccgtgtgcttgagcgtctgaatgctggcaaaaccgtgcgaagctttctgatcaccgccgtcgagctcctgaccgaggcggtaaatcttctggtgcttcaggtattccgcaaagacgattacgcggtgaagtatgctgtagaaccgttactcgacggcgatggtccgctgggcgatctttctgtgcgtttaaaactcatttacgggttgggcgtcattaaccgccaggaatacgaagatgcggaactgctgatggcattgcgtgaagagctaaatcacgacggcaacgagtacgcctttaccgacgacgaaatccttggaccctttggtgaactgcactgcgtggcggcgttaccaccgccgccacagtttgaaccagcagactccagtttgtatgcaatgcaaattcagcgctatcaacaggctgtgcgatcaacaatggtcctttcactgactgagctgatttccaaaatcagcttaaaaaaagcctttcaaaagtaagcaacgtctgcttactgcccctctacctgcttcggccgataaagccgacgataatactccagacgttgtagatataacggcacgctttcatcgggtattccggacggaatcgcgttacggggaggaagttttttcagatactcccggaacgcctggcttgatgccatgaaatctacggctttatcgataagaagcggaacgttttcacctaatttgcccatgatgatatctccgtattaccccgcgccgggaatgcgcggccgccaattttagtttaggttcccggtaaagatgacattaaggaaaacgtgctgaatcctcaataatcatccgctgctgtttattatcttttttctatagatttcttaattaatcaacgaattgcgcagtttttgagcatgttaatgattacgttacagaactattacaatgtcattagttgtgaacaaagcacctggtcgcgcatactaggggctataaatttatctttatcagaagccatcacatgaaagaagtcgaaaaaaacgaaatcaaacgcctcagcgatcgcctggacgccatccgccaccagcaggccgatctttcgctggttgaagccgcagacaaatatgccgagctggaaaaagagaaagccacgctggaagcagaaattgctcgcctgcgtgaagttcatagccaaaaactgagtaaagaagcacagaagctgatgaagatgccattccagcgcgcaattaccaaaaaagagcaggctgatatgggcaagctgaagaaaagtgttcgcggactggtcgttgtgcacccaatgaccgcactgggccgcgaaatgggcctgcaggagatgactgggttttcaaagaccgcgttttaagaacacagtatctacagggtgattctgcacattcctataggccgagtaaggtgttcacgccgcatccggcaagataaggcgctctggatcaacaacctaagggcaattctctgatgaggattgcccttttctttaccagacatctccccccacaagaattggccctaccaattcttcgcttatctgacctctggttcacaatttcccaattaaaactcacatcaatgttgccaatacataacatttagttaaccattcattgtcattatccctacacaacacaattggcagtgccacttttacacaacgtgtgacaaggagatgagcaacagactcattacacgatgtgcgtggactccaggagacctgcaatgaatctctggcaacaaaactacgatcccgccgggaatatctggctttccagtctgatagcatcgcttcccatcctgtttttcttctttgcgctgattaagctcaaactgaaaggatacgtcgccgcctcgtggacggtggcaatcgcccttgccgtggctttgctgttctataaaatgccggtcgctaacgcgctggcctcggtggtttatggtttcttctacgggttgtggcccatcgcgtggatcattattgcagcggtgttcgtctataagatctcggtgaaaaccgggcagtttgacatcattcgctcgtctattctttcgataacccctgaccagcgtctgcaaatgctgatcgtcggtttctgtttcggcgcgttccttgaaggagccgcaggctttggcgcaccggtagcaattaccgccgcattgctggtcggcctgggttttaaaccgctgtacgccgccgggctgtgcctgattgttaacaccgcgccagtggcatttggtgcgatgggcattccaatcctggttgccggacaggtaacaggtatcgacagctttgagattggtcagatggtggggcggcagctaccgtttatgaccattatcgtgctgttctggatcatggcgattatggacggctggcgcggtatcaaagagacgtggcctgcggtcgtggttgcgggcggctcgtttgccatcgctcagtaccttagctctaacttcattgggccggagctgccggacattatctcttcgctggtatcactgctctgcctgacgctgttcctcaaacgctggcagccagtgcgtgtattccgttttggtgatttgggggcgtcacaggttgatatgacgctggcccacaccggttacactgcgggtcaggtgttacgtgcctggacaccgttcctgttcctgacagctaccgtaacactgtggagtatcccgccgtttaaagccctgttcgcatcgggtggcgcgctgtatgagtgggtgatcaatattccggtgccgtacctcgataaactggttgcccgtatgccgccagtggtcagcgaggctacagcctatgccgccgtgtttaagtttgactggttctctgccaccggcaccgccattctgtttgctgcactgctctcgattgtctggctgaagatgaaaccgtctgacgctatcagcaccttcggcagcacgctgaaagaactggctctgcccatctactccatcggtatggtgctggcattcgcctttatttcgaactattccggactgtcatcaacactggcgctggcactggcgcacaccggtcatgcattcaccttcttctcgccgttcctcggctggctgggggtattcctgaccgggtcggatacctcatctaacgccctgttcgccgcgctgcaagccaccgcagcacaacaaattggcgtctctgatctgttgctggttgccgccaataccaccggtggcgtcaccggtaagatgatctccccgcaatctatcgctatcgcctgtgcggcggtaggcctggtgggcaaagagtctgatttgttccgctttactgtcaaacacagcctgatcttcacctgtatagtgggcgtgatcaccacgcttcaggcttatgtcttaacgtggatgattccttaatgattgttttacccagacgcctgtcagacgaggttgccgatcgtgtgcgggcgctgattgatgaaaaaaacctggaagcgggcatgaagttgcccgctgagcgccaactggcgatgcaactcggcgtatcacgtaattcactgcgcgaggcgctggcaaaactggtgagtgaaggcgtgctgctcagtcgacgcggcggcgggacgtttattcgctggcgtcatgacacatggtcggagcaaaacatcgtccagccgctaaaaacactgatggccgatgatccggattacagtttcgatattctggaagcccgctacgccattgaagccagcaccgcatggcatgcggcaatgcgcgccacacctggcgacaaagaaaagattcagctttgctttgaagcaacgctaagtgaagacccggatatcgcctcacaagcggacgttcgttttcatctggcgattgccgaagcctcacataacatcgtgctgctgcaaaccatgcgcggtttcttcgatgtcctgcaatcctcagtgaagcatagccgtcagcggatgtatctggtgccaccggttttttcacaactgaccgaacaacatcaggctgtcattgacgccatttttgccggtgatgctgacggggcgcgtaaagcaatgatggcgcaccttagttttgttcacaccaccatgaaacgattcgatgaagatcaggctcgccacgcacggattacccgcctgcccggtgagcataatgagcattcgagggagaaaaacgcatgattatttccgcagccagcgattatcgcgccgcagcgcaacgcattctgccgccgttcctgttccactatatggatggtggtgcatattctgaatacacgctgcgccgcaacgtggaagatttgtcagaagtggcgctgcgccagcgtattctgaaaaacatgtccgacttaagcctggaaacgacgctgtttaatgagaaattgtcgatgccggtggcactggctccggtgggtttgtgtggcatgtatgcgcgtcgtggcgaagttcaggcagccaaagcggcggacgcgcatggtattccgtttactctctcgacggtttccgtttgcccgattgaagaagtcgcgccagccatcaagcgcccaatgtggttccagctttatgtactgcgcgatcgcggctttatgcgtaacgcgctggagcgagcaaaagcagcgggttgttcgacgctggttttcaccgtggatatgccgacaccgggcgcacgctaccgtgatgcgcattcaggtatgagcggcccgaacgcggcaatgcgccgctacttgcaagcggtgacacatccgcaatgggcgtgggatgtgggcctgaacggtcgtccacatgatttaggtaatatctcagcttatctcggcaaaccgaccggactggaagattacatcggctggctggggaataacttcgatccgtccatctcatggaaagaccttgaatggatccgcgatttctgggatggcccgatggtgatcaaagggatcctcgatccggaagatgcgcgcgatgcagtacgttttggtgctgatggaattgtggtttctaaccacggtggccgccagctggacggtgtactctcttccgcccgtgcactgcctgctattgcagatgcggtgaaaggtgatatagccattctggcggatagcggaattcgtaacgggcttgatgtcgtgcgtatgattgcgctcggtgccgacaccgtactgctgggtcgtgctttcttgtatgcgctggcaacagcgggccaggcgggtgtagctaacctgctaaatctgatcgaaaaagagatgaaagtggcgatgacgctgactggcgcgaaatcgatcagcgaaattacgcaagattcgctggtgcaggggctgggtaaagagttgcctgcggcactggctcccatggcgaaagggaatgcggcatagtcgtttgcgccccctcaccctaaccctctccctcagggagaggggaccgttcggcgctgtatgtactccctcactctgaaacgacaccgcactctttttttctccctcgcccctccggggagagggccggggtgaggggaaaaggccgcactgctcaccaattttctgctatcctgcccccgcactaagggggcagtatgctaaacatcgtactttacgaaccagaaattccgccaaatactggcaacatcatccgtctttgcgctaataccggctttcgtctgcatatcatcgaaccgatgggatttgcctgggacgataagcgcctgcgccgcgcggggctggactatcacgagtttaccgccgttacgcgtcatcatgactatcgcgcgttcctcgaagcagaaaatccccagcgcctgttcgccctcaccacgaaaggtacacctgctcacagcgccgtaagctatcaggatggcgattatctgatgttcggcccggaaacacgcggcctgccagcgagcattcttgatgccctgcccgctgaacaaaaaattcgcattccgatggtgccggacagccgcagcatgaatctgtccaatgcggtgtcggtagtggtgtatgaagcctggcggcagttggggtatccgggagcggtattgagagattagttactgtaggccggatagatgattacatcgcatccggcacgatcacaggacattagatcccatccccatactcaaatgtatggttaataccgttgaaatgctggtccatatccattgatggcttatcgctgtctggtttaccgacaatacgagccggaacgccagcggcggtggtatgcggcggcaccggttgcagcaccacggaacctgcgccaatcttcgcgccgcgcccaacttcaatattgccgaggattttcgcgcccgcgccaatcatcacaccttcacgaattttcgggtgacggtcaccaccagatttacccgtaccgccaagcgtcacagattgcagaatcgatacgtcgttttcaatcaccgccgtttcaccaacgacgatgcctgtcgcgtggtcaagcatgataccgcgaccaatttttgctgccgggtgaatatcgacctggaacgtcacagaaacctggttttgcagaaagattgccagtgcgcgacgcccctgattccacaaccagtgaccgatgcgataggcctgcaaggcatgaaaacccttcaggtataacaacggggttgagtatttatcgactgccgggtcgcgggtacgcaccgcctgaatatcacaggccgcagaggcgatcatttccgggtcagcggcgtaggcttcttccaccacttcacggatagcaatagcaggcataattggcgatgacagcttgttcgccagcatgtagctcagtgcactgccaaggttttcgtgcttgagtagcgtcgcgtggtaaaaactggccagcattggctcacagtccgccagcgttctggcttcggctttaatattgttccagacaatttccagttcttcacacgacattgcttactccacacgatgagataatgaccggcccgttctgcgcgggccgggtcatagcggtaacaaaggttccctggggttagtggctgctgcgctcgtccttgcgtgcacgacctagtaaagtcaatgctgcctcgcgcgcgttttttccgcaatataatacttgataaatttcctcggttattggcatttcaacgccgaagcgatgcgccagttcgcggacttctttcgtattgcggtagccttccaccacctgaccaatcttctcctgcgcgctttgtacatccatgccctgaccgagcatcatgccaaaacggcggttacgcgactggttgtcggtacaggtaagcaccagatcgccaagccccgccatgcccataaaggtggcagggtcggcacccagcgccgcaccaagacgcgacatttcagccagcccacgggtgatcagcgccgtacgcgcattcgcaccaaaaccgataccgtcggacatccccgcaccaatggcaataacgtttttcaccgcgccgccaagctgcacgccaatgaaatccggattgctgtaaacgcggaaacttttgccgcagtgcagcagctgctggagatcatcggcaaaggtctgatcggtcgaggccagcgaaatagctgtcggtaaacctgccgccagttctttcgcaaacgttgggccagagataaccgccagcggaatttgatcgcctaaggcctcacgcgccacgtcctgtaacagacgtccggtttccgcttccagccctttggtcgcccacaccagacgcgcatcaggacgcatcagtggtttaatctggcgcagcacttcaccaaagacatggctgggtacgacgacgagaatattacggctggctgccagcgcagtggcgagatcgctttcaagatggagcgtatcgggaaaaggcacatcggggagaaacgcggcgttacagcggtcgcgttcaagcgttgcgatatgttcagggtcatggccccagaggacaacctcgtggccatttcttgccagggtgatggcaagagcggtgccgtacgagccggcaccgatcacagtcattgaagcattacgttggttcatcaggcatcctgatgttcttcagtaccttcgccagcctgctgctgcaaatagttcatgaacagcgcatcgaagttaaccggcgcaaggttcagttgcgggaatgtaccgcgggataccatgctggtgatgcactcacgagcatacgggaacagaatgttcgggcagtatgctcccaggcaatgcgccatctgggtgccttcgatacccgcgatggagaaaataccgccctgctgaacttcacacaggaacgcggtttcttcgcccaaagaggccgttacggtaacacgcagtaccacttcgtatacgtcatctgccagttgggaagatgccgtatccagatcaagtttaacttctggttgccaatctttctggaaaacgtgcggcgcgttcggcgcttcgaaagagatatccttggtataaatacgttggatctggaaagtcatttcagtgttgttttgttctgacatgtgtagaaaacccttaagtgttgtccttaaatactgcgcaatgtaatgccaacgttcacacgttatttcagcaggggatccagtccaccacgtgcatccaatgcatacaagtcatcacagccgccaatgtgctgtgcgtcaataaaaatctggggaaccgtggtgcgaccgctgcgtttgatcatctcttcacgcttggcggcgttgccatcgatcggcagctcctggaaactcacgcccttgctgctcagcagtgcttttgcacgatggcaatacgggcaggtttctttggtatagatttcaacattggccataaattagctcctgtttttttaccctgaaatttcatgttgcagggcggcagcaaaatggagtgtccccagaagcttataacaataagtcgctgggggcctaattgcagctaacggcctgcatcatgaaagacgacaggtaaattatttgccgcgcaccaaaggcaagttttcgccagcccagccagcgacgccttctttcagcacgaatacttgcgcaaaaccagctttcgtcagtgcgtttgcaggctcctggcactgcatgccagaaccgtctaccacgataaccggtttgtctttgtgcttctcaagctcaccaacattgttggctttgatttcgctcggcaacagattaatagaacctgcgatatggcctttacggaagtcatcacgctgacgtaaatccacaaccacagcgtcttctttgttgatcagacgcgtagcttcaccacgagtaatcaccttcactttcgaggtcaggctcttaaacgtagtcacaagaaccgccaccagtaacgcgatccaggcgatactcagtatgggatgacggccaacaaattgcataatttcttgcatggggggtaacaactcccgacgtagtgattaaaaaaaccaggaaaggagtatacctgcgcggtgcggcaaatacagccagcgcgttaactggaatgcaattttgcggggcgcgacgaaaaaaaagcgtaaatctggcatcggcttgccgcgagcggtcgtatattttgatcttcagaggctattttatcgattcagctgtagtaaaattacgcaaattttgactcttgagtatgaggttgtcgcaatgttggtttctaaaaaacctatggtactggtgattctggatggctatggctatcgcgaagaacagcaggataacgccatttttagtgctaaaaccccggtaatggatgcactgtgggccaatcgtccgcataccctaatcgacgcttccggtctggaagtcggtctgcctgaccgtcagatgggtaactccgaagtaggccacgttaacctgggtgccggccgcatcgtgtatcaggacctgactcgtctggacgttgaaatcaaagatcgcgctttctttgctaatccggtgctgactggcgcggtagataaagcgaaaaacgcaggcaaagcggtacacattatgggtctgctctccgcaggcggcgtacacagccacgaagatcacatcatggcgatggtagaactggcagctgaacgcggcgcagaaaaaatctacctgcacgcattccttgacggtcgcgacactccgccgcgcagtgctgaatcctcgctgaaaaaattcgaagaaaaatttgccgcgctgggcaaaggccgcgtagcgtccatcattggtcgttactacgcgatggaccgcgataaccgttgggatcgcgtagaaaaagcttatgacctgctgactctggcgcagggcgagttccaggccgataccgccgttgctggtttgcaggctgcttatgctcgcgacgaaaatgatgaattcgtgaaagcgaccgttatccgtgctgaaggtcagccagacgcggcaatggaagacggcgatgcactgattttcatgaacttccgtgctgaccgcgcgcgtgaaatcactcgtgctttcgtgaacgctgatttcgatggcttcgcgcgtaagaaagtggttaacgtcgatttcgtgatgctgaccgaatacgccgctgacatcaaaactgcggttgcttacccacccgcttccctggttaacaccttcggcgagtggatggcgaaaaacgacaaaactcagttgcgtatttccgaaaccgaaaaatatgcccacgttactttcttcttcaacggtggcgtagaagagtcgttcaaaggcgaagatcgcattctgatcaactcaccgaaagtggctacctacgatctgcaaccggaaatgagctccgcagagctgaccgaaaaactggttgcggccatcaagagcggcaaatacgacaccatcatctgtaactatccgaacggcgacatggtaggtcacaccggggtgatggaagcggcggttaaagcggttgaagcgctggatcactgcgtggaagaagtcgcgaaagcggttgagtccgtgggtggacaactgctgatcaccgctgaccacggtaacgctgagcagatgcgcgatccggcaacgggtcaggcacacacggcacacaccaacctgccagttccgctgatttacgttggtgataagaacgtgaaagcggttgaaggcggcaaactttctgacatcgcgccgaccatgttgtcgctgatgggtatggaaatcccgcaagagatgactggtaagccgctgttcatcgtggaataatccctccccatgaggggaaaggcgattaataccatgacacgggccgtgaaaccgcgcaggtttgcaatcaggcccatcatctacgccagcgttcttagcgctggcgtattgttgtgcgccttttccgcccacgcggatgagcgtgaccaactcaaatctattcaggctgacatcgccgcaaaagagcgcgcggtacgccaaaagcaacaacaacgcgcaagcctgctcgcacaattgaaaaagcaggaagaagcgatctctgaagccacccgtaagctgcgcgaaacgcaaaacacgctcaatcaactcaataaacagattgatgagatgaacgcgtcgattgccaaactggagcagcaaaaagccgcccaggagcgcagcctcgccgcacaactggatgccgcattccgtcagggcgagcataccggtattcagctgattctcagcggtgaagaaagccagcgtggacagcgtttacaggcttatttcggctatctcaaccaggcgcgacaagaaaccattgcccagttgaagcaaacgcgtgaagaagtcgccatgcagcgtgctgaactggaagagaaacagagcgagcaacaaacgctgttatatgagcagcgcgcccaacaggcgaaactgactcaggcgctgaacgagcgtaaaaagacgctggcagggctggagtcttccatccagcaaggtcagcaacagttgagcgagctgcgcgccaacgaatcccgtctgcgtaacagcattgcccgtgcggaagccgcggcgaaagcgcgtgcagaacgagaagcacgtgaggcccaggcggttcgcgaccgccagaaagaagcgacgcgcaaaggcaccacctacaaaccgaccgaaagcgaaaaatcgctgatgtcccgtaccggtggtctgggcgcgccgcgtggtcaggcattctggccggttcgcgggccgacgctgcatcgctatggcgaacagctacagggtgaattacgctggaaaggtatggttatcggtgcttctgaaggtactgaagttaaagcgattgccgacggtcgggtgattctggctgactggctgcaaggctacggtctggtggtggtggttgagcatggtaaaggcgacatgagtctttacggctataatcagagcgcactggtgagcgttggttcgcaggttcgcgcgggccagccgattgcactggtgggcagcagtggcggtcagggtcggccttcactctatttcgaaattcgccgccagggtcaggcggtcaatccacagccgtggttgggaagataagttttgtttccatttcgtcgtaacgttcttgcatttgccgctctgttggcgctctcctcccccgtacttgctggcaaacttgccatcgtcattgatgattttgggtatcgcccgcacaacgaaaaccaggtgctggcgatgccttccgctatctccgtcgctgtattacccgattcaccgcacgccagagagatggcgaccaaagcgcataacagcgggcacgaagtgttgattcatctcccgatggcaccgttgagtaaacagccgctggagaaaaatacgctacgcccggagatgagcagcgacgaaattgagcgcattattcgtagtgcggtcaataacgtgccctatgccgtggggatcaacaaccacatgggcagcaagatgacctctaacctgtttggtatgcagaaagtgatgcaggcgctggagcgttacaatctttacttcctcgacagcgtaaccatcggtaatacccaggcgatgcgcgccgcgcaaggcactggcgtgaaggtgatcaaacggaaggtattcctcgacgattcgcaaaatgaagcggacatccgtgtgcaatttaatcgcgcaattgacctggcgcgtcgcaacggttcgaccattgccattgggcatcctcaccctgcaacggtacgcgtgttgcaacagatggtttataacctgccgccagacattacgctggtgaaagccagcagcttgctgaatgaaccgcaggttgatacttctacaccgccgaaaaacgctgtgcctgatgcaccgcgtaatccgttccgtggcgtgaagctgtgcaaaccgaagaaaccgatagaacctgtttatgctaatcgcttctttgaagtattaagcgaaagcatcagccagagcacgctgatcgtttacttccagcatcagtggcaaggctggggcaaacagcccgaagcggcgaagtttaacgctagcgcaaattaaaggcgctacgcgtaatgcgatggtgcgaccgcgttttgtcgcgccattgccataagcggaaagaccacagtaacgcctggtaaccgaccttcacgctgcgcacattggtaatcaggcgcttatacataccggaagtaaatatctcggcaatcatccgttggcgggtaagaatatccggctctttgcgcaccgcatggcaaacacgcaatgcctcgtaagttatttgctgatgaaattccggataaatcataattttgtcggcataatttcgatttaatttctccagcaggcgggtaatcttaatatagtgacgttgataattaaggtttttattcccttgtctatgcaaccgactcactgacgtattatgcagataatatttatataatgattgctcggtatatcgcgcacgcagcgcgttaaacatgaattctgttgtccagacaatatcctgatgatgtaatccggcaataaatttaatgttatttttaacaataacatcacggcgataaacccccatccagacaacgtgagtccaacggcgcgaagaaagccccatccgcagccagtccgggccggttaatacgccggttgagcgaaggcgatcggtggggatggattgccaggtttctcccgtttcacgaaaacaccagtcagcgttgcactgcgccacgtcgaggtcgtcctctaacgccatggtcatcagcgtttcgtacatggtgggatagacttcatcgtcagcatcgacaaaagcgacatatttgcccgttgccacttcaatcccacgattacgcgccaccgatgcgccagcattcgcctgatgcaacaaacgaacgtgcggatagttttctgcgtaatactttgctatttcaacagaattatccgttgaaccatcgttaataataatgatttccagagcagtccaggtttgcgtaattaaagattccatacaagtgcggaaatcatcgcccgcattatataacggaataataacactaagtttattggtgctgttcatcataaattaccgacgacctctgaagttatcctgacgttttacaggctttgtattaagaaactattaagcctgtgagatattatttttacaggtgagagagtcacttcagggtagagagataatgagagcagctatataagagatcagcacaattacgaactctttattacactgacaggattttacatatttaacagattatcctcagataaaagggctggaataccagcccttgttcgtgttaatcccagctcagaataactttcccggactggcccgaacgcatagcgtcaaagcccttctggaaatcatcgatagagaaacgatgggtaatgatcggcgaaagatcgaggccagactgaatcagcgccgccatcttgtaccaggtttcaaacatctcacgaccgtaaatacctttaatgaacaagcctttaaagatcactttggtccagtcgatagacatatcagacggcggaatacccagcatcgcaatacggccgccgtgattcatggtgtcaagcatggtacgaaacgctggcggcgcaccggacatttccagaccgacatcaaaaccttcggtcatgcctaactccgccatcacgtcattgagattttctttggcgacgttaaccgcacgggtgatacccattttacgcgccagctcaaggcggtattcgttaacatcagtgatcaccacattgcgtgcaccaacgtgtttcgccaccgccgctgccataataccaatcgggcctgcaccagaaaccagcacatcttcgcccaccagatcaaacgacagcgcggtatgcacggcgttaccgaagggatcaaaaattgcggctaagtcatcggaaatattgtcggggattttgaaggcgttgaatgccgggatcaccagatattcggcaaagcagcccgggcgattaacaccaacgcctatcgtgttgcggcacaaatgggtacgaccaccacgacagttgcggcaatgaccacaggtgatatggccttcgccagaaacgcgatcgccgatcttgaagcctttcacttcctgaccaatacctaccacttcaccgacatattcatggcccacgaccatcggcaccgggatggttttttgcgaccactcatcccagttatagatgtgaacgtcagtcccgcagatggctgttttacggattttaatcagcagatcgttatgcccgagttccggtacaggaacgtcggtcatccagatgccctcttccgctttcagtttggataacgctttcatctcacatcctcaggcgataacgcccagttgtttaccaatacgcgtaaatgcttctactgcacgcgtaatttgctcaggggtatgcgccgcagacatctgggtacgaatacgcgcctgacctttcggaacgaccggatagaagaaaccggtaacgtaaatgccctctttttgcagctcacgggcaaatttctgcgccactaccgcatcaccaagcatgaccggaataatggcgtgatcggctcccgccagggtaaagcccgccgccgacatttgctcacggaactgacgcgcgttcgcccacagacggtcacgcagttcgctgcccgcttcgaccatctccagtactttgatggacgcggcaacaatggccggtgccagcgagttggagaacaggtacggacgagaacgctggcgcagccactcaaccacttctttgcgcgccgcggtataaccaccagaagccccgcccagcgctttaccaagcgtaccggtgataatatcgacccggcccatcacatcgcagtattcatgggaaccacgaccattttcaccgacaaaaccgaccgcgtgggagtcgtctaccatcaccagggcatcatatttatctgccagatcgcaaacgcccttcaggttggcaatcacgccgtccattgagaacacaccatcggtggcgatcagcacatgacgcgcaccggcttcacgcgcttctttcagacgtgcttccagctcctgcatatcgttgttggcatagcgatagcgtttagctttgcacagacgcacaccatcaataatagacgcgtggttcagtgcgtcggagataatggcgtcttccgcacccagaagcgtttcaaacaggccaccgttagcatcaaagcaggaagagtagagaatcgcatcttccatccccaggaaggccgccagtttttgttcaagctctttatggctgtcctgagtgccgcaaataaaacgcaccgaagccatgccgaaaccgtgagaatccattcccgcctttgccgccgcaatcagatcaggatgattcgccagcccgagatagttgttggcacaaaagttaatgacgtggcttccatcagccacagtgatatctgcttgctgcgcagacgtaataatgcgctcttctttaaacaacccttccgcccgtgcggtttccagatcgttggttaactgctgataaaattctccacgcattgcgattctccagacagggcaaattccagcacatattacccaaacttataggtcgcgacgagataacgcgttaacacttctgcaaaattcaggataaataacgtgtaacttgatgtctctcaacacctacagatagtagaaaaactgtacagttttggctgggcataatgatgattgattttactgcattgatataaaaagaaaaaatgatgccaaagcatcatttttcctatctcagttggtatcaaaacgctacccactaatggagggaaacctattttcttgaaaggaaaattctcagcgcctgcatttttgcccctaaagtgttactcctgaagcagcgaaacaaatcgaaccattttcctctccccagatagtttaggttgaagagatcggggcgtttgtaatagcacatgacaaaaatgccctggtcatcgtccacaatgttattatttagtgttattttttgactttccagaactaatttatagaattctttccatttatgctgtgaaccaacaattgcgcccccaataatatatacatgattgccaatcatgaaatcaaaaacctgttgttgagatgtgacagtaagccctttttttatagtgaaaagatgcatcttactttcatcaaatgggaaatcccaaattttcaatcctcgagttacatttggcttatggcaatagccaaaatctatccacgcaacaagaggcgttttcactaagcccatgttgatagctttatttacaaaataggccttaaggttacataccaaaacatactctggtgaccagtactctgggttttttaattgtcgaggctcaagtctatttgtaaacgactcatctttttgaattttttcgatacgacttctgatatatctaaatttcttttttatatcgataacgataaccgttgttggttttccgttgcgaatcgcttcaacccttggtttcaaatcgggagaagtgaaaataatcatctcattttcaagtgcggccagacgctcaaagtaactaaaataaacatcaactgaacgagctagtttttcacggaaccctttattagcagtccaatcccctctaccaatgtcaaaatatgcagtgataattgtggtggatgatttcattactaataagaccattaatataaaaaaagaattatatcataaatattaatagaatgtatactgtatattatccattcaaatgcttccgttatttatcatacatcggaatattgatactaaagcactattcacatgcaaaaccaacatccgccatgaaggactagctaaaacccaaactagtttgttgcaattagcatccttgcacctctatgtaaagggctgaagggattcggatgtgatggtatgattacagacattcgtgtctgagattgtctctgactccataattcgaaggttacagttatgatcatcgttaccggcggcgcgggctttatcggcagcaacatcgttaaagccctgaatgataaaggcatcaccgatattctggtggtggacaacctgaaagacggcaccaagtttgtgaacctggtggatctgaatatcgcagactatatggataaggaagacttcctgatccagattatggctggcgaagagttcggcgatgtcgaagcgattttccacgaaggcgcgtgctcttccaccaccgagtgggacggcaagtatatgatggataacaactatcaatactccaaggagctgctgcactactgcctggagcgtgaaatcccgttcctgtacgcttcttccgcagccacctacggcggacgcacctccgactttattgaatcccgcgagtacgaaaaaccgttgaacgtctacggttactcaaaattcctgtttgatgaatatgttcgtcaaatcctgcctgaagcgaactcgcagattgttggcttccgttatttcaacgtttatggaccgcgtgaaggccataaaggcagcatggcgagcgtcgctttccatctcaacacccagcttaacaacggtgaatcaccgaagctgtttgaaggtagcgagaacttcaaacgcgacttcgtctatgtgggcgacgtggctgatgtgaatctgtggttcctggaaaatggcgtttccggcatcttcaatctcggtactggtcgtgcggaatccttccaggcggtagctgatgctacgctggcttatcacaagaaaggccagatcgaatacattccgttcccggataaactgaaaggccgctatcaggcgttcactcaggcagatctgacaaatctgcgcgcggcgggttacgacaaaccgttcaaaaccgttgctgaaggtgtaacggaatacatggcctggctgaatcgcgacgcataagagctctgcatgaaaatactggtgatcggcccgtcttgggttggcgacatgatgatgtcgcaaagtctctatcgcacgctccaggcgcgctatccccaggcgataatcgatgtgatggcaccggcatggtgccgtccattattatcgcggatgccggaagttaacgaagctattcctatgcctctcggtcacggagcgctggaaatcggcgaacgccgcaaactgggtcatagcctgcgtgaaaagcgctacgaccgcgcctacgtcttacccaactccttcaaatctgcattagtgcctttcttcgcgggtattcctcatcgcaccggctggcgcggcgagatgcgctacggtttactcaacgatgtacgcgtgctcgataaagaagcctggccgctaatggtggaacgctatatagcgctggcctatgacaaaggcattatgcgcacagcacaagatctgccgcagccattgttatggccgcagttgcaggtgagcgaaggtgaaaaatcatatacctgtaatcaattttcgctttcatcagaacgtccgatgattggtttttgcccgggtgcggagtttggtccggcaaaacgctggccacactaccactatgcggagctggcaaagcagctgattgatgaaggttatcaggtggttctgtttggctcggcgaaagatcatgaagcgggcaatgagattcttgccgctttgaataccgagcagcaggcatggtgtcggaacctggcgggggaaacacagcttgatcaagcggttatcctgattgcagcctgtaaagccattgtcactaacgattctggcctgatgcatgttgcggcggcgctcaatcgtccgctggttgccctgtatggtccgagtagcccggacttcacaccgccgctatcccataaagcgcgcgtgatccgtttgattaccggctatcacaaagtgcgtaaaggtgacgctgcggagggttatcaccagagcttaatcgacattactccccagcgcgtactggaagaactcaacgcgctattgttacaagaggaagcctgacggatgcgggttttgatcgttaaaacatcgtcgatgggcgatgttctccatacgttgcccgcactcactgatgcccagcaggcaatcccagggattaagtttgactgggtggtggaagaagggttcgcacagattccttcctggcacgctgccgttgagcgagttattcctgtggcaatacgtcgctggcgtaaagcctggttctcggcccccataaaagcggaacgcaaagcgtttcgtgaagcgctacaagcagagaactatgacgcagttatcgacgctcaggggctggtaaaaagcgcggcgctggtgacgcgtctggcgcatggcgtaaagcatggcatggactggcaaaccgctcgcgaacctttagccagcctgttttacaatcgtaagcatcatattgcaaaacagcagcacgccgtagaacgcacccgcgaactgtttgccaaaagtttgggctatagcaaaccgcaaacccagggcgattatgctatcgcacagcattttctgacgaacctgcctacagatgctggcgaatatgccgtatttcttcatgcgacgacccgtgatgataaacactggccggaagaacactggcgagaattgattggtttactggctgattcaggaatacggattaaacttccgtggggcgcgccgcatgaggaagaacgggcgaaacgactggcggaaggatttgcttatgttgaagtattgccgaagatgagtctggaaggcgttgcccgcgtgctggccggggctaaatttgtagtgtcggtggatacggggttaagccatttaacggcggcactggatagacccaatatcacggtttatggaccaaccgatccgggattaattggtgggtatgggaagaatcagatggtatgtagggctccaagagaaaatttaattaacctcaacagtcaagcagttttggaaaagttatcatcattataaaggtaaaacatgctaacatcctttaaacttcattcattgaaaccttacactctgaaatcatcaatgattttagagataataacttatatattatgttttttttcaatgataattgcattcgtcgataatactttcagcataaaaatatataatatcactgctatagtttgcttattgtcactaattttacgtggcagacaagaaaattataatataaaaaaccttattcttcccctttctatatttttaataggcttgcttgatttaatttggtattctgcgtttaaagtagataattcgccatttcgtgctacttaccatagttatttaaatactgccaaaatatttatatttggttcttttattgttttcttgacactaactagccagctaaaatcaaaaaaagagagtgtattatacactttgtattctctgtcatttctaattgctggatatgcaatgtatattaatagcattcatgaaaatgaccgcatttcttttggtgtaggaacggcaacaggagcagcatattcaacaatgctaatagggatagttagtggcgttgcgattctttatactaagaaaaatcatccttttttatttttattaaatagttgcgcggtactttatgttctggcgctaacacaaaccagagcaaccctactcctgttccctataatttgtgttgctgcattaatagcttattataataaatcacccaagaaattcacttcctctattgttctactaattgctatattagctagcattgttattatatttaataaaccaatacagaatcgctataatgaagcattaaatgacttaaacagttataccaatgctaatagtgttacttccctaggtgcaagactggcaatgtacgaaattggtttaaatatattcataaagtcacctttttcatttagatcagcagagtcacgcgctgaaagtatgaatttgttagttgcagaacacaataggctaagaggggcattggagttttctaacgtacatctacataatgagataattgaagcagggtcactgaaaggtctgatgggaattttttccacacttttcctctatttttcactattttatatagcatataaaaaacgagctttgggtttgttgatattaacgcttggcattgtggggattggactcagtgatgtgatcatatgggcacgcagcattccaattatcattatatccgctatagtcctcttactcgtcattaataatcgtaacaatacaattaattaagaataaacaagtttaagaagtgagttaaaactcacttcttatctatacaacttaatctctttactgaattagttaaagtttcagtatcgatatcttttaccgtatatgttggggatactatttgtatagatttatgatgattcggggaccaaattaaatgcgagggatattccggagtacgtgaattagggtaaaatgcaagcgttggtttatgataagccgcagcgatatgaacaagagctgtatcaacagaaatgacaaaatcactatacttggtcaacgcaacggtataaataaactcatcaaatggtagtgtttcgatttcaagtattggtattgtcaataaatcttgcggtaacccggtaaatataatccgataattttcaaagtgtgttttcacttcttgatatataacttttatttgctcaaacgtaagacggcatattttttttgcacctaatggattaataatgactattcttgtatctccaataaattcttttattttatcttcaacatctactggtaaatgcaagtcgtagttggtggaaaatttaccctcaccataaatatgcttcagtatttctattgctcgtgtactcatatgttcttttaaacattcatcgtggggatggtaaaatgaatagtaacgcttataccaatgatcaaaacccagaatgtaagaatcttttaaacttgataatattaagctatgcttaaatgagggcatagtttcaaaggggtctaatacaatatcgaactgtaaatcccgcagatgcttacatagagtaagcatttcaagaaaaccggttgattctttaatacagaactcaaatatatttttattattagagagaaattccccaccctttctatttgtgagaagagttattttaacccctttactataaagttcacgataaatcgaacttaatacaattagatcaccaagtttattattatcatgaataataaggcatgatttaacttgtgctggatctgtaatttgattatttattttattacgaaataaaaaagaaaggaaattaatcttgattttgtttatataaaatcttttctttttgtgaaaagttcctaagcgcatttttataccatattattttagtttcaggatgattaattagcataagaatcggttgaagttctatattgcattttttttcttgtcatatcttttgattcttctgcactgatgtcttgaagtttaataaatggaattacatcgtaagaaatagctgtatcatctgataaattataaatattaatatcttttacattatcatgcataaaacgaaaaaatggcaatattttgaataaatccctacttaattccgagggcatgggatttttattctcatcatagaaacgagaacagctacccgttaaatcaagaccagaacaaataatccgcgcatacttaagtgaatatgcgatttgaattgcagcaaaggcaatagtatggcatgagcaataaccaagactaatgtccttgcaaaatccaaccagacgaccttttttagacaacggtacagagatcagcagttctttgtgaatctgtctcaaaatattaaatttaatcttctttataaaaccacctttttcccgacggtaaaaggaccgtaatacgaggcagttctggaggatataaagtttatcttctttggaagcgtgttcataaacgtcaacgtttactatggtataacgacttctctggctaaatttataaaaatcatcacgacgctgatgtaaaaatcggacatctgtaagtacatatataaaaggaacgatattattacttaacagatattgcgcagaaccattgacagcaataatatcctttgttcgtaatactgacaaaggtgttttttgcgatgtagggcccgaaagaaaaataataacatcatcagatattttattttcaatcaggttttcaacatcttttttgtcaatgtatctaatattcttcatgataaacctgtgaaataaataactccgcttaaaactgtcctggtgaagacatgtaattgtgggattttttttagcgcgctggtttccctttcaaacgccgcataaaattgcgcatttttttacgatatactaaaagataatagcctagatctctaatctcatttttaataccgtaatgacgctctaagtcaatacgatctttcgctttacgctgcgctgaagcacgctttccggagagatcgataattcgaacctcaccattttttataatgaagttaccacgatgggggtcgccagaaaccatgccatgttgatgtaaggcattaattgattgctgaattttattttttagcgcatcatcaatatcgggcatatcacacaactctatgccatcaatatactcgatgatcatgatataagtatggacaaaacgtaaggttttccgttcagccaataaataaaagtcattgagtgtatttaacccttcatttcgtactttttgggtttgctcaaaaaggcgttcgtaataatcaccttttaacagagacttaaagaaacgttcgttacgcttaactttcggagaaaaaaccttaagaatcaatttaccgtaatcggtatcaataagcataacttttgtatcatcaatagaacgaaaaaccttgatgatatttatattataagacaagaagtcatttaatacattgaggtactttgaattgttttcatcggtaaaaacaaccaagtctttgatcttgctcttctgaatcataataaaccagttaaatgttatttacggtaatattttcggcaaagataacagactcctgctataattcctgagatataatgatgttgcactaaaagatgtttatatctttttttaaattcaataattgatttcgcatctcgtggagagtcatctttccagggggaattttctaaagctattttatagtattttaccgatggataaattgcccatttgtgccacggtttagttgcacctgtataatgaataagaagagtactttctgtaatcagctttttatagttttgatgtgttttgtcttttaattcacttttaattgtataaattgtattgtactcacgaggcaaaaataatgtcatccctttcagtaagacattcataacatcctgatcagggtatttataaacattatctttactcataagaatagacaacgctttttctgttagttttgcgtcagcccatttttttaagtctaaataaacgacaccggaattaaagtactgcccaagtaattcaggatcagacaacctggataccgccttttcttgcattggctcaacatctttaacaacagcagcaaccgctccatttaaacccagatgtaatagttggctaatatcgcctttacaaacaacatctgcatcaagataaagcaaacgatcaagcgttaaacccaataattgaaatgcaaataaacggaagtacattgctcttgaccagacctgtgtacaaggcaagcactggagcttatcagtgttaattctatataacgtgattcttaattggttttgctctgcaagctttgcaattttttgaaaaaaaccatcattataaacatcagcaataatataaaaatcaagattaatatgtcgattatttaggacaattgatgtgatggaaacacctacaccatcaagataattagcatcgacaccataggcaacatttaaacattcagaagtatttatattagctagccgaaaatcccaggctttaactttatctatctctatggcaggaaatgagtccacaatgctacccttatatcattactttatagtttcccagttttaatgctttatcttttcaataaaataaaaaagatagttgctaaatccttttagatatctatgctttttaagcatatgttttgcgctatatcttaattgattgctattgttcggtttcagcaacgccgtattcttccatggcgaagcattttttgcctccataaaggcttgtgatacaggataatcccaggcccaatcatgccagggcttggttggcccgatataatggataaaaatagtatcgttggttactgggtttataaagctttctttgagttgataatttaagctgaactgggtgttatatttaatatcagcgaaaataagtttatccgccagcaacatatttaacacatcctgatcaggatgtgttatttttttgattatttctggctcatttagcattgcaatagctcgtgcagaaacctgctgagccgcccattgggcagtattaatcaataaaaaaccggagttaaagtaacctttagcaattcccgcaacacctaacgaatgggcgcgtttttcccaccagtcagcttgcccttctgtaacaaccattgcgactttatcgtcaggaaatgagaaattaattagtggctcaatagtcccctgacaaatgatatctgcatccagataaaggactttaggcgccttattaataaagtaatctgcaataacaaaacgaaaatatattgcatgagtccaattcttagtgctaggcaatgagcgcagtcgatcaccattaatcagatatattttaattctggttttatactgcaacgccagggcatcaaaatacttacgatcatcatcaccaaaataatcagtaaaaatatggaaacacaatcgacttccttcattatattttaatattgaagcaatcgaaattccgcaaccaaatagaaagtttttgtcagttccataagcgatgtccagacaaagattttctgtttctactttatgatcataatcaataactgaattaagaaactcagtttcctggaaaaacacctgctgcattatttcctccgggaaatagcagaaataattaccttatgtaatctatcgtaatacttcgattggtaaaattcatcgatcgacgcaggaattttttcatgttcgatatgaatttcacctgctatatatttatttagaagagttacaaaaccagcaatatctcccggttgatacagatggccattgacatcaggttgaataatgtcagcaggcccggagacacaatcggcactgatacaaggaatcccccacgacaaggcttcaagtagggtcattgggaaaccttcaaaagatgacgtgagcaataacgcactcactttttcaatatcttgctggaccaattcccagggatattgttgccaaccataccagacaattcgatcatcaatatttaattctctaccataagcctggcatttttcgaaatcggagccatcacccaatacatggagtttccagttacctttcgcttgtgataagccatcaagcaggtctttaactcttttctggccttcaaatttcatacgcccaacataaataaacgttgccgtttcaccttcctcgggcgcgggaatgactgagtctttagtttcgacgggattaaaaataacatttatcgtcgattctgctacacctcgattaatcatttgctgtttaatgccagagctgattgctaaatgatagtcggcacaggtgatatattcagcatgttttttgtgatctaaagaaaaatgtggccatgaaaatactggcatatcaattcctgattttttacgtgcttttgcggcaaacaggcaggagatcacatcaatacaaataacgatatctggttggtactcctgaagccatttacttagagcatgaatatgtttcgcccgacgcaaaaaacctaaacgaatattggaaaatgaacatgagtatttaataccttccagccatcccttatccattttgtcattacgacaaaagaaaaacatttcactttggatatgttgttgcctgaaggtagtaataacatcacggatgacagtttccatgccgccaaatccagaaacagcttcgccgataaacgctattttcatagaaactctcattaattgagtaaaactcactgttttaacggttttatttgtctataaaatcagaaacaatcgttgacatcattttatctggactgaatttatataaactatcataatccattggtttaacagatgagttaataaaatactctaacttatcccaatcatcatgacctattataaaaaagcgagattcactatagatttctgaaccaaatacatttatattattagtaattaattttttattgaaaaatagtgcctcaagtatacgaagagtccagccagattggttttctttggttatatcaacaattatattagcatttaatgttcttctaatattctcttcataagatatttgtttttcaatcaaatactttgaagtcgtagatgatgtcttatctttgacaacattaaaatctagcttacatcctagtgttgttaatctctcggctaactcattaattatttgaagacgccctttatcacgaccaaggaaaaaacatattggctggctgttatttttgtcagataaactataatttctaatttcatccattcctataggaaaaaattgttctattgccttgatcttttcattccctataaatctatgctcaaaatcatatataatatcgaaataattcgcgttatcaagaataaaatcttcgccaacagtatttcttagaagcaaaactttatgacagttaatattttttaatatttgtttattgatacctttattaacaacactgtcattaatgataattatgtcatcttttttaatatcattgaggtaatgcttgatgaataatcgccccagccatgcattatccatccctatttttgatatttttttattaatccagttatatttttttggtgttgttatattttttatcttgtacttttttttcaggtactgaatcatttttaattcataatctgcaacccaatttataaaataaatagtcataataaagttagttccagtacatactaataaatatttttataatcctttgcgttgtgttcgctctttaatacgctcggccttaacgcttgccatgttcaataaattctgttcaagagacaatattttgcgtaaaggcatcccaaaataaaccttcataaatcgccagatatctctttgcgtcaggccaatattcattgatgagaaatataaaccaatcaggtctttatcgcgccagcggcgcggtacttttgcacgtatctgtgcccgatgcagatcgataactgaaatttttaattcatcttcccggccagtaaatggcaaatgaagcaaaaagtggcaaatgtaacagtcgcggtgatttatccctgcagtatgcattttacgcaccatagttgctacacgtgcgatcagcatacgcttaacacgtatatcaggcgggttgactgcccaatcggcacaataatcttcaaggctaattgtgggagtgagatcttcggtaataataaatgatgcgcgagttaatggatttaaccctttttcgccaaacccaatgcccttcattgtatcaacgccaacatcactcaggcgatgaatagcgtgccactctctgtctgcgcccaaaacgggcatccgcaatgagagtagattttttataatctcttttaatgtcgtccccttgtgccatttaagaaaatagcttttcccggacagttcaaagcgtaatgtacgacgagtctccagttcacgaaagacctcgccgttcagttttttgacctctgcaaaagcatctttaccacgccaaagtgtggcaagcggctcttttaattcaaccatctaaaccacctgtaatgatatccgcggctttttctggcaagctatacaaatcctgagtatcggcataatggcgagcattctccgcccaggccattcgcaatggcgactgagttaacgctttacgtaaaacttcatttaattgttcctgagagaaaggttcagcgatgaccgttccacaattggcatccgcaatataatgcgcgtacccacataccgctgttgttaaaacaggtaacccagcagtgatcgcttctagaagaacgatacccgcggcttcctgataagcgggatgcagtaataaatcagcggctgccattaattctgacacatcattgcgaccggagaagaaatgcacattgctccgcacgccgagtttttctgccagcgcttcaaattttcgcggcttatcctgaccaacaacaaataaaagcgtattgtgacgtaatgattccggtaacgatgccaaagcttcaattgagcgatctacacctttacggccaaaatctgatccaacctgcagtaataagttttgttgctcttttatgccatttttctggcgataaatttcacggctgtttgggatttgctcactgtattttctgtccggataaataccgggaggaagaatttgaaaacgttcaggttcagtttgataatgcttctggaaatcggcgatttgcttatcggtcagcatcataagtttcgtcgatttaccctgctcgaaagtcgctcgctcaaatgcggcataatggcgatatcgtgatgttaaacgatataaaaaacctttttcttgcgcaactttctcggcgtaacaaacatcagcggcaaaataaacatccaggccaggcatcttattaaacccaacaacgcgatctgcgggatgctctttgagatgattttgtacccaggcataatattctgcattgcgtccatggttggtatgggacttaactggcacctgaataagctcaaatgctttcgggcaatcgccttcccacgactgtgtatatacccgaacatggtggccccgtgcggcaactgttgatgcaatgcgcataaagtcacgttgaagcccaccaaatggaaaatatttatataaacaaaacgccacgatcataattgtgcattcctgtcagctgaaggggcatcttctggcaacagcttttccgtagcggcgatcacatcctccgctgggataacagaaagatattttttgttgcggtcaagttcatgccgggtcggcattttctgataattccccgcccagaattgaataatattctcggtccagggacgccagaatacgtgatccgttgcaccaaatagactaatgactggcgttttcactgccgctgcaatatgtcccggcgcagaatccacaccaataaaaagcactgcatgatcaattaatgcacccagttcaggaaaacgtgttttacctgcaaggccagtaatgggttttgtttcgcaacctcgtgcaatctcatctacacaagcgagatcatctgccgagggcccacaggttagcacaacctgatagcctcgctgttgcagcgcatcgataaccttagaaaatttatcgttatcccaacacttaaatatctgacgcgctgtcggttggatgacaacataatgatcttttacgcccagggcatctaattcccggcgcatcttcttccagcaatcttcggcgtaactcattgttgtgtcggtgtagaaatcggtaatacctaatggctcaaggaccgataaattacgctcaacaatatgtgtaccgtgtattggcgctaagtgtgtgaagctttttttccaaataccatgctgccgatgaccataaagttgcgatattttcatccgtgcaggtaaacaacgtaccagcagcgccaccatccactgatccgtaagattaatgaccaggtcataattattcgcacgcagagtttttatcaacgaaagcacatttttaattttatcgaaagttcccgcacctttattgcttatcccatagagcgcattaatttccgggttttcagacaaaatagggatggtgtcctgataaagcagcatatcgatttttgcatcaggataattctgcttgagcgtactgatgacaggagtagttaataacatatccccatgatatcgcatctttatgaccaggatttttcgaaatggcttttccactagcgactcttttgtgtgattgtctggttaagttaagcagaaaaaagcacgctaccgccccaggctcaacagctacctgaatactgataacgcacttactttgacgtgctagtgtatcatttctttcgcagcaatccgacccgaatgatttttatacacaaaatatactttaatcataaaaatcaaatagataaaaaatagcatttcgataatgtcagtacggcctatgtagatttgaaaatggggccgagtttcaatgaatcgcataaaaatacaaaaaaaatgaagatgtagcggcagatcagaccaaactgaagctatttaagtcaaaaacgggaaaagtaatggtaaagccacagctaaatacatagaatccccagcacatccataagtcagctatttactatgctcgaattgctttacaccgcccttctctaccttattcagccgctgatctggatacggctctgggtgcgcggacgtaaggctccggcctatcgaaaacgctggggtgaacgttacggtttttaccgccatccgctaaaaccaggcggcattatgctgcactccgtctccgtcggtgaaactctggcggcaatcccgttggtgcgcgcgctgcgtcatcgttatcctgatttaccgattaccgtaacaaccatgacgccaaccggttcggagcgcgtacaatcggctttcgggaaggatgttcagcacgtttatctgccgtatgatctgcccgatgcactcaaccgtttcctgaataaagtcgaccctaaactggtgttgattatggaaaccgaactatggcctaacctgattgcggcgctacataaacgtaaaattccgctggtgatcgctaacgcgcgactctctgcccgctcggccgcaggttatgccaaactgggtaaattcgtccgtcgcttgctgcgtcgtattacgctgattgctgcgcaaaatgaagaagatggtgcacgttttgtggcgctgggcgcaaaaaataatcaggtgaccgttaccggtagcctgaaattcgatatttctgtaacgccgcagttggctgctaaagccgtgacgctgcgccgccagtgggcaccacaccgcccggtatggattgccaccagcactcacgaaggcgaagagagtgtggtgatcgccgcacatcaggcattgttacagcaattcccgaatttattgctcatcctggtaccccgtcatccggaacgcttcccggatgcgattaaccttgtccgccaggctggactaagctatatcacacgctcttcaggggaagtcccctccaccagcacgcaggttgtggttggcgatacgatgggcgagttgatgttactgtatggcattgccgatctcgcctttgttggcggttcactggttgaacgtggtgggcataatccgctggaagctgccgcacacgctattccggtattgatggggccgcatacttttaactttaaagacatttgcgcgcggctggagcaggcaagcgggctgattaccgttaccgatgccactacgcttgcaaaagaggtttcctctttactcaccgacgccgattaccgtagtttctatggccgtcatgccgttgaagtactgtatcaaaaccagggcgcgctacagcgtctgcttcaactgctggaaccttacctgccaccgaaaacgcattgaggttgttatgcaaaaacgggcgatttatccgggtactttcgatcccattaccaatggtcatatcgatatcgtgacgcgcgccacgcagatgttcgatcacgttattctggcgattgccgccagccccagtaaaaaaccgatgtttaccctggaagagcgtgtggcactggcacagcaggcaaccgcgcatctggggaacgtggaagtggtcgggtttagtgatttaatggcgaacttcgcccgtaatcaacacgctacggtgctgattcgtggcctgcgtgcggtggcagattttgaatatgaaatgcagctggcgcatatgaatcgccacttaatgccggaactggaaagtgtgtttctgatgccgtcgaaagagtggtcgtttatctcttcatcgttggtgaaagaggtggcgcgccatcagggcgatgtcacccatttcctgccggagaatgtccatcaggcgctgatggcgaagttagcgtagcgtttatgccggatggtatgccatccggcgcgcatgaattacttctggcactgccgacaataaaacgttgcccgctgcgcatgtttagtcgccacaatcggcgtaccgcacacccgacacggctcaccttttcgcccgtaaacctgcaattcctgagcgaaatagcccggtttaccatcactttgcagaaaatctttcagcgttgtaccaccctgctcaatcgaacgcagcaacaccgctttaatcacccgagctaacaattcacactctgccagcgacagtgatgacgccagccgatccggatggatccccgccgcaaacagtgattcgctggcatagatattccctacccctaccaccagcttgttatccatcagccacggtttaatcgccgtttttttcttcgcgcacttctgatgcagatactcaccattgaaatcgtcgctaagcggctccggtccaagatgggtcagcacattatgcccttccagctctttggtccacagccaggcaccaaagcggcgcggatcggtgtagcgcagcactttgccgttgctcatcaccaaatccacatggtcatgcttttcagggggaagttcttctggaaggatgcgcaggctgccagacatccctaaatgaatgataatccagccctcaggcagctccagcagcagatatttagcccgccgctgcacgctaagcactggttggtcgcttaaacggtagatctcttctgaaaccggccagcgcaagcgtccgttgcgcaccactgcatgaagaatggttgcaccaacgagatgcggttctatgccgcggcggctggtttcaacttcgggtaattcaggcatagcatctccaggaatgaacagatgcagtcaatatgggggcaagcagataacaaaaaaccccgccggagcgaggttttttgttacatcaaagcgagaattatttgattttcgcttctttgtagatcacgtgctggcgaacaactggatcgaattttttcagttccagtttttccggcttagtacgtttgttcttcgtagtggtatagaagtgaccagtaccagcagaagaaaccagcttgattttctcacgaatacctttagccatgatttatttcctctaagtacttagtacttttcgccacgggcacgcagttcagccagaactgtatcgatgccttttttatcgattacacgcatacctttagcagatacgcgcagggtgacaaaacgcttctcgctctcaacccagaaacggtgagagtgcaggttcggcaggaaacggcgtttagtcgcgttcagtgcgtgggaacggttgttaccggtcaccggacgcttgccagtaacttggcagactcgggacatgtctattctccaaaaatcaaattagctcgagcttcgtatggggtattggcgcctcgtcaggctttacagcccggtcatcgcagttctatgtgaactctcgattgccaggcccaaatgccaaacccgagattctcaaaggtggcgtagtatacgctgactcagcgatgtgctcaagtcccgaacagacaaagatcccgaaggatcgcgcatagcgggttaaatccagccgcgttcggcaaaagaaacatactctccacgcccaatcacgatatggtcgagcacgcgtaaatccatgaactgacaactctttattatccgttcagtaatgagtttatccgctttactgggttcagcacaacccgaagggtgattatgtgcaaggatcagcgccgaggcgtttatttttatcgcttcgcggataatttcccgaggatggacttcaacatggtttagcgtgccggaaaaaagacgcctatgcgttataacccggtgttgggagtcgagaaagatcaccataaagatctcccgctcctcacccgtgagctggctttgtaaaaattccctcgtcatctccgggctgagtaaagggctttcttcacgcatccgcacgttgtagtaacgccgcgccagttcagcaatcccctttaactgggcaaatttcgccacgccaattccatgaacgccactaaattgttcatattcagaggttaacaagccataaagagagccgaaattctccagcatctcttttgccagggttaatacatctttaccgcgcgttccggtacgcagaaatagcgccagcagctcgacatccgttaaggcgctaataccaaacttcagcattttttcgcgcggcatcaacagctgtgaattgtttttcaccttcacctcctttgtggtgctcgcatcctgtcatagccgtttcgttaaatcgacggccagttttcaatcctggaaagcgcctcgcaaagtgaatctcaggtgaaggcacgacaacaaaagtattgtgataaaatcgccaacttctggtgtcaccctacaggaaaaatcatcatgagcctggccggtaaaaaaatcgttctcggcgttagcggcggtattgctgcctataaaacccctgaactggtgcgtcgtttgcgcgatcgcggggccgacgtccgcgtagccatgaccgaagcggcaaaagcctttatcaccccacttagcttgcaggcggtttctggttatcccgtttccgacagtctgctggacccggcagccgaagccgctatgggccatattgagctgggtaaatgggctgatttagtgattctcgcccctgccacggcagatttgattgcccgtgttgctgccggaatggcgaatgacctggtatcgacgatttgtctggctacacctgcgcctgtagccgtgctccccgccatgaaccagcagatgtaccgtgccgctgccacgcagcataatttagaggtgcttgcttcccgtggtttgctcatctgggggccagacagtggcagtcaggcttgtggtgatatcggtcctgggcgaatgctcgatccgttaaccattgtggatatggcggtagcgcatttttcgcccgtcaacgacctgaaacatctgaacattatgattaccgccggcccgacgcgtgaaccgctcgatccggtgcgttatatctctaatcacagctccggcaagatgggttttgctatcgccgccgccgctgcccgtcgtggcgcgaacgtcacgctggtatcaggtccggtttcactaccgacgccaccgtttgttaaacgtgttgatgtgatgaccgcgctggaaatggaagccgccgtgaatgcttctgtacagcagcaaaatatttttatcggctgcgccgccgtggcggattatcgcgcagctaccgtggccccagagaaaatcaaaaagcaggccacgcagggtgatgaattaacaataaaaatggttaaaaaccccgatatcgtcgcaggcgttgccgcactaaaagaccatcgaccctacgtcgttggatttgccgccgaaacaaataatgtggaagaatacgcccggcaaaaacgtatccgtaaaaaccttgatctgatctgcgcgaacgatgtttcccagccaactcaaggatttaacagcgacaacaacgcattacaccttttctggcaggacggagataaagtcttaccgcttgagcgcaaagagctccttggccaattattactcgacgagatcgtgacccgttatgatgaaaaaaatcgacgttaagattctggacccgcgcgttgggaaggaatttccgctcccgacttatgccacctctggctctgccggacttgacctgcgtgcctgtctcaacgacgccgtagaactggctccgggtgacactacgctggttccgaccgggctggcgattcatattgccgatccttcactggcggcaatgatgctgccgcgctccggattgggacataagcacggtatcgtgcttggtaacctggtaggattgatcgattctgactatcagggccagttgatgatttccgtgtggaaccgtggtcaggacagcttcaccattcaacctggcgaacgcatcgcccagatgatttttgttccggtagtacaggctgaatttaatctggtggaagatttcgacgccaccgaccgcggtgaaggcggctttggtcactctggtcgtcagtaacacatacgcatccgaataacgtcataacatagccgcaaacatttcgtttgcggtcatagcgtgggtgccgcctggcaagtgcttattttcaggggtattttgtaacatggcagaaaaacaaactgcgaaaaggaaccgtcgcgaggaaatacttcagtctctggcgctgatgctggaatccagcgatggaagccaacgtatcacgacggcaaaactggccgcctctgtcggcgtttccgaagcggcactgtatcgccacttccccagtaagacccgcatgttcgatagcctgattgagtttatcgaagatagcctgattactcgcatcaacctgattctgaaagatgagaaagacaccacagcgcgcctgcgtctgattgtgttgctgcttctcggttttggtgagcgtaatcctggcctgacccgcatcctcactggtcatgcgctaatgtttgaacaggatcgcctgcaagggcgcatcaaccagctgttcgagcgtattgaagcgcagctgcgccaggtattgcgtgaaaagagaatgcgtgagggtgaaggttacaccaccgatgaaaccctgctggcaagccagatcctggccttctgtgaaggtatgctgtcacgttttgtccgcagcgaatttaaataccgcccgacggatgattttgacgcccgctggccgctaattgcggcacagttgcagtaatatgacgccggatgacttttcatccggcgagtttctttaaacgccaaactcttcgcgataggccttaaccgccgccagatgttccgccatttccggcttctcttccaggtaagcaatcaggtctttcagggtgatgatagagatcactttgcagttgtaatcacgctcaacttcctgaatcgccgaaatctcgccgcgcccgcgttcctgacgatcgagcgaaatcaacacgccagcaagcgtcgcgccattggcctgaataatctccatcgactcgcgaatcgccgttccggcggtgatcacatcatctaccagcattacgcgtccttgtaacgcgctaccaaccagattgccgccttcaccgtggtcttttgcttctttgcggttaaagcagtacggcaggtccaggtcgtgatgctccgccagtgccacagcggttgtggtggcaatcgggatccctttgtaagcagggccaaacagcagatcgaactcaatgccggaatccaccaacgcttcagcgtaaaaacggcctaacagtgccagatcgcgcccggtattaaacagcccggcgttgaagaaataggggcttttgcgcccggatttcagcgtaaactcgccaaactttaacacctgcttgctaagcgcaaattcaataaactggcgctgatatggtttcatgccttcgctcctcatcttacttttctacagacaaaaaaaaggcgactcatcagtcgccttaaaaatcagtttgccagcgccgccttctgcgtcgctacaatggattcgattcccctcgggccagagccaacaagatgagtagctcttcatgggtgaacggctcgccttctgccgtcccctgcacttcaatgatgcgcccgtcttcggtcatcactacgttcatgtcggtctctgcggcagagtcttcaacgtattccagatcgcaaaccgcttcgccgttcacaattccgacagaaactgcggctaccatccctttcatcggattggttttcagcttgccgttttccaccagcttctgtagcgcatctaccagcgccacgcaggcacccgtaatcgacgcggtacgcgtgccaccatcagcctgaagcacgtcgcagtccagcgtaatggtgaactcacccagcgctttcaaatctactgccgcgcgaagagcacgggcgatcagacgctggatttccattgtgcgtccaccctgcttacctttcgccgcttcacgagcgttacgggtgtgggtagaacgtggcagcatgccgtactctgcggtgatccagccctggccctgacctttcaggaagcgcggcacgccttcttcaatagaggcggtacacaacactttggtatcgccaaattcgaccagcaccgagccttctgcatgttttgtatagttacgagtcagggtaacgggacgcacctgattattgctacggcctgctggacgcatattgaaatctccggcttgaaacaaatgtggctgcgcattatacggacttccggcggttattcctatcctgacaaggcatcgatggctataatccttccacctctccttttataaacaggaacgtctatgatccgcagtatgaccgcctacgcccggcgtgaaatcaagggtgaatgggggagcgcaacctgggaaatgcgctcggtaaaccagcgttatctggaaacttactttcgtctgccggagcagttccgtagccttgaacctgtcgttcgcgagcgtattcgttctcgcctgacgcgcggtaaagtggaatgtaccctgcgctatgagccagatgttagcgcgcaaggtgagctgatcctcaacgaaaaactggctaaacagctggtaactgccgcgaactgggtaaaaatgcagagtgacgaaggggaaatcaacccggttgatattctacgctggccgggcgtgatggcagcccaggagcaggatcttgacgccattgccgctgaaattctcgcggcgctggatggtacgctggacgactttattgtcgcgcgcgaaaccgaaggtcaggcactgaaagcattgatcgagcagcgtctggaaggcgtcaccgccgaagtggtcaaagtccgctcccatatgccggaaatcctgcaatggcagcgtgagcgtctggtcgcgaagctggaagatgctcaggtgcaactggaaaacaaccgtctggagcaggaactggttctgctggcacaacgaattgacgttgccgaagaactggatcgcctcgaagcgcatgtcaaagagacctacaacattctgaagaaaaaagaagcggttggtcgtcgtctggattttatgatgcaggagttcaaccgcgagtcgaacactcttgcgtcgaagtctatcaatgccgaagtgacaaactccgccatcgagctgaaagtgttgattgagcagatgcgcgagcagattcagaacatcgaataactcgtaacgccaattcttacttttccgccttcacaaatgccgccactcaaacagagcggcatttttcttccccgcaacattcaattctgttttgcgtgcctgctccagattttgcgatgtttttttgcccagcacactgagaacgtgagatactcacaactgtatataaatacagttacagatttactttctttgcaattgatatcacatggagtgggcaatgaacgaacatcatcaaccttttgaagagataaaactgattaatgcaaacggagcagaacaatggtcagcaagacaacttgggaaactactgggttattcagagtatcgtcactttatacctgtattaacgcgcgccaaagaagcctgtgagaacagtggtcacacaattgatgaccatttcgaggagatcctcgatatggtcaaaattggctcaaatgccaaaagagcattaaaagacatcgtactctcccgctatgcctgttacctggtagtacaaaacggcgaccctgcgaaaccggtcattgcggcagggcagacttattttgctatccagacccgacggcaggagcttgctgacgatgaagcatttaagcaacttcgtgaagacgaaaagcgtctgtttctgagaaatgagttgaaagaacataacaaacaattggttgaggcagcacagcaagctggggtagcgacagctactgatttcgccatatttcagaatcatggttaccaggggctgtatggtggattagatcagaaagctattcatcagcggaaggggctgaaaaagaatcagaagatcctggatcatatgggttcaacagaactggcggctaatctctttcgagctacccaaacagaagaaaaactcaagcgggatggcgtgaattcaaaacagcaagcaaacaccacacactttgacgtgggtcgcaaggtgaggcaaaccattcaggaacttggcggaaccatgcctgaggagttgccgaccccgcaggtcagcatcaagcagttggaaaacagtgtaaaaattacagagaagaaatagcagaaactaaaaactctttttgttgattgagacacccgatgcgtaagccaaggtccaggtgcagtgaacacaatggctaaatattgcacctttcttttccccctcagttttaacctattttttcttatgcattttctcagacaagaagtcagaagaatgcatctctgctacagaaaatagcgatttcacataactacaagttatcaatttcccctccccttaaaaaatctcaatcgtgacaatgcgcacaaatcgctaccctgccagacagatttttagggagagaaccatgctgttacacattttgtatttggttggcattactgccgaagccatgacgggggcgctggcggccggacgacggcgcatggatacatttggcgtaattattattgcgaccgccaccgcaattggcggagggtcagtgcgcgatattctgctgggccactatccgctcggctgggtcaaacacccggaatatgtgattatcgtcgctaccgccgcagtactcaccactatcgttgctcctgtaatgccttacctgcgcaaagtgtttctggtgctcgatgcgctcggactggtggtcttttctatcatcggggcacaggttgcactggatatggggcacggcccaattattgccgttgtcgcggcggtaaccaccggcgtgtttggcggcgttttgcgcgatatgttctgtaaacgtatcccactggtattccagaaagagttgtatgccggtgtctcatttgcctccgccgtgctgtacatcgcgctgcaacactatgtttctaaccatgatgtggtaattatctccaccctggtattcggcttttttgcccgcttactggcgctacgccttaagctgggattaccggtcttttactacagccacgaaggacactaaggttcaaaacctgtgatctgctgggcagccagccaactgcccagcttcttgatttgcgcattttccttccattcaataacctgtctggcgcgtcccgatccagtccccggcagctgctgccagaactgctccgtgctaaataaaagttgcgaccaggaccgttcatcactggcattaagcgccgcccgggttagcggtattcccattgccatcacccagcgagtaaaaggctgcttacgagccagattaaactgatgccatagctgcgcacttttacttttcgcgatccccggcgtgttctgtaattgctctggcgttaataaaagccaggaaaagatatgttcaaagcgatgagtctgatgcagcgcgcgccaaccggcctcaccaatgccatccagcccaagaacctgttttgcccccagccagactaagcgtgaaatgaactgttcctgacaaacatcagaagcaaagtagcaggtcaacgagttaaagcggttttctggcggtgtcggttttgtacgttctgcaccgcgccacaccacatcatcaatgcgaggaataccctgaccggcaaggctgacgagaatctgatcaccaggcgcaatatcccactcctgccagcgcctgacggaaccaatattcacccgctggacttttttatcatccagcatgacaggtgcgagtgacgcaaccaccgatattttaccgctcttacccaccgcaaactgaattgccttcacttcggcaacctgagctacaggttgatatttccaggccaccagccactctgcctggcccggtagccaatggcgggattctggctctttcgccgctcgtacaactacgccatcggtgacgaagggtaattccgctttccaccactcattgcgtacgcgcgcaacttcatcagcatttttcaccgcacgggtatacgtctgcgttagagtaaaacctgcggtagccagctcttttaaacgatcagacattaactgcggtccatccggccatgcccagacaaaaacgcccagagaattcagcgtgtcgctatcgtcctggcgcatcatcaagccagcaacttttgcgcgggcatttattccccccatttgttgttggatatgcccctcgcgctggagaaatatttccccctgaagcgtactgttggctaaaggcccgctaacggtttgcggcacagcggaaattaagctaactttctgcgtccagtcctcgcctttcaggccattaccgcgactgattgctttgttcagtttcccgtcccgataaaccagggttaccgcaacgccatcaacttttggctgcacccaaagatcgctacgttctcgcatccacagacttaatgcgtttttatccaccattttgcgtacacccgtatgggcaaccggatgcataaccgcaccatttaaaggcggcatcatcacgtcgcggggctcgctcccaaagcagcgttgccactgcgtaagacgggcgcttaactgatcgtaaacaccgtcttccacctcactttttccttccttccagtagtcatcgtcccactgttttatttgctgttgcaggcgggaaatttcttcctgtgctctggctggcgaccaggccggacagaccgcccacacagatgattgccagcacaagatacctattaatatcgccatccatactttcatcatcacctccgctgtagatagtcaggcagatatacaacgtgatgaaagcaaagccgagtggcaaaaacggagtctgcgaggacgcttcctgaaaatcgtctttattgcagtgaatgacaggcaaatgcggaagcagctacgcaaaacgcaacaactttgcgcaaaaagtgtgagcaagggctacgtcacatggccgcgccgtgtataataagctcgtatgtaggctttatttcgctaatcacatacgaaagatactcatggctcaaggcacgctttatattgtttctgcccccagtggcgcgggtaaatccagcctgattcaggctttattaaaaacccaaccgttgtatgacacccaggtttctgtttcacacaccacacgccaaccgcgtcctggtgaagtccacggtgaacattatttctttgttaatcatgatgaatttaaagaaatgattagcagagatgcgttcctcgaacacgcagaagtttttggtaattactatggcacttcgcgtgaggccattgagcaagtactggcgaccggtgtcgatgtttttctcgatatcgactggcagggcgcgcagcaaattcgccagaagatgccgcacgcgcggagtatctttattttaccgccgtccaaaattgaactggaccgccgtctacgcggtcgcggtcaggacagcgaagaggtcattgcaaagcgtatggcgcaagctgttgcagaaatgagccattacgccgaatatgattatctgattgtgaatgatgacttcgataccgcgttgaccgatttgaagaccattattcgcgccgaacgtctgcgcatgagccgccaaaagcagcgtcatgacgctttaatcagcaaattgttggcagactgaacctgatttcagtatcatgcccagtcatttcttcacctgtggagctttttaagtatggcacgcgtaactgttcaggacgctgtagagaaaattggtaaccgttttgacctggtactggtcgccgcgcgtcgcgctcgtcagatgcaggtaggcggaaaggatccgctggtaccggaagaaaacgataaaaccactgtaatcgcgctgcgcgaaatcgaagaaggtctgatcaacaaccagatcctcgacgttcgcgaacgccaggaacagcaagagcaggaagccgctgaattacaagccgttaccgctattgctgaaggtcgtcgttaatcacaaagcgggtcgcccttgtatctgtttgaaagcctgaatcaactgattcaaacctacctgccggaagaccaaatcaagcgtctgcggcaggcgtatctcgttgcacgtgatgctcacgaggggcaaacacgttcaagcggtgaaccctatatcacgcacccggtagcggttgcctgcattctggccgagatgaaactcgactatgaaacgctgatggcggcgctgctgcatgacgtgattgaagatactcccgccacctaccaggatatggaacagctttttggtaaaagcgtcgccgagctggtagagggggtgtcgaaacttgataaactcaagttccgcgataagaaagaggcgcaggccgaaaactttcgcaagatgattatggcgatggtgcaggatatccgcgtcatcctcatcaaacttgccgaccgtacccacaacatgcgcacgctgggctcacttcgcccggacaaacgtcgccgcatcgcccgtgaaactctcgaaatttatagcccgctggcgcaccgtttaggtatccaccacattaaaaccgaactcgaagagctgggttttgaggcgctgtatcccaaccgttatcgcgtaatcaaagaagtggtgaaagccgcgcgcggcaaccgtaaagagatgatccagaagattctttctgaaatcgaagggcgtttgcaggaagcgggaataccgtgccgcgtcagtggtcgcgagaagcatctttattcgatttactgcaaaatggtgctcaaagagcagcgttttcactcgatcatggacatctacgctttccgcgtgatcgtcaatgattctgacacctgttatcgcgtgctgggccagatgcacagcctgtacaagccgcgtccgggccgcgtgaaagactatatcgccattccaaaagcgaacggctatcagtctttgcacacctcgatgatcggcccgcacggtgtgccggttgaggtccagatccgtaccgaagatatggaccagatggcggagatgggtgttgccgcgcactgggcttataaagagcacggcgaaaccagtactaccgcacaaatccgcgcccagcgctggatgcaaagcctgctggagctgcaacagagcgccggtagttcgtttgaatttatcgagagcgttaaatccgatctcttcccggatgagatttacgttttcacaccggaagggcgcattgtcgagctgcctgccggtgcaacgcccgtcgacttcgcttatgcagtgcataccgatatcggtcatgcctgcgtgggcgcacgcgttgaccgccagccttacccgctgtcgcagccgcttaccagcggtcaaaccgttgaaatcattaccgctccgggcgctcgcccgaatgccgcttggctgaactttgtcgttagctcgaaagcgcgcgccaaaattcgtcagttgctgaaaaacctcaagcgtgatgattctgtaagcctgggccgtcgtctgctcaaccatgctttgggtggtagccgtaagctgaatgaaatcccgcaggaaaatattcagcgcgagctggatcgcatgaagctggcaacgcttgacgatctgctggcagaaatcggacttggtaacgcaatgagcgtggtggtcgcgaaaaatctgcaacatggggacgcctccattccaccggcaacccaaagccacggacatctgcccattaaaggtgccgatggcgtgctgatcacctttgcgaaatgctgccgccctattcctggcgacccgattatcgcccacgtcagccccggtaaaggtctggtgatccaccatgaatcctgccgtaatatccgtggctaccagaaagagccagagaagtttatggctgtggaatgggataaagagacggcgcaggagttcatcaccgaaatcaaggtggagatgttcaatcatcagggtgcgctggcaaacctgacggcggcaattaacaccacgacttcgaatattcaaagtttgaatacggaagagaaagatggtcgcgtctacagcgcctttattcgtctgaccgctcgtgaccgtgtgcatctggcgaatatcatgcgcaaaatccgcgtgatgccagacgtgattaaagtcacccgaaaccgaaattaatgttttatgaacccaacacgttatgcacgcatctgcgaaatgctcgccaggcggcagcctgatctgaccgtctgcatggagcaggtccacaaacctcataacgtttctgcgattattcgtaccgcagatgccgttggcgtacatgaagttcacgccgtctggcctggtagccgcatgcgcaccatggcttcggcagcggcgggtagtaacagctgggtacaggtgaaaacacaccgcaccattggcgatgccgtcgctcatctcaaaggccagggcatgcagattctggcaacccatctttctgataacgctgtcgatttccgcgaaattgattacactcgcccgacctgcattttgatgggacaggagaaaacgggcatcacgcaggaagcattggccctggcggatcaggacatcatcattccgatgatcggcatggtgcagtcgctgaatgtttccgttgcctcagccctcattctttacgaagcccagcgtcagcggcaaaatgcaggcatgtacctgcgtgaaaacagcatgttgccggaagcagagcaacaacgcctgttgtttgaaggcggctatccggtgctggcgaaagtcgcaaaacgcaaaggcctgccttatccccacgtcaatcagcaaggcgagatcgaagctgatgccgactggtgggctactatgcaggctgcagggtaagtgccatgaaaggtcgcctgttagatgctgtcccactcagttccctaacgggcgttggcgcagcacttagtaacaaactggcgaaaatcaacctgcataccgtgcaggatctactcttacaccttcccctgcgctacgaagatcgcacccatctctaccccatcggagaactactgccgggcgtttatgccacggtggaaggcgaagtgctgaactgcaatatctccttcggcggtcggcggatgatgacctgccagatcagcgacggttccggcatcctcaccatgcgctttttcaatttcagcgcggcaatgaaaaatagcctggcggcgggccgccgtgtactggcttatggcgaagcaaagcgcggtaaatatggtgcggagatgatccacccggaataccgcgtgcagggcgatctcagcacgccagaattacaggaaacgctcacgccggtttatccaacaacggaaggcgtaaagcaggccacgctgcgtaaattaaccgaccaggcgctggatctgctcgacacctgcgccattgaagaactcctgccgccggaactgtcacaaggaatgatgacgctaccggaagcgttgcgcactttgcaccgcccgccaccgacgctacagcttagcgatctggaaaccgggcagcatccggcgcaacgtcgtctgattctggaagaactgctggcgcacaacctcagcatgttagccttacgtgccggagcacagcgttttcatgcccagccgctgagcgccaatgacacgctgaaaaataaactcctcgccgccttaccgttcaagccaacgggcgcacaggcacgcgtagtggcggagatcgagcgcgatatggcgctggatgtgccgatgatgcgtctggtgcagggcgatgtaggttccggtaaaacgctggtcgccgccctcgccgcgttgcgtgcgattgcccacggcaaacaggtagcattgatggcaccaaccgaattactcgccgagcagcacgccaataacttccgcaactggtttgcaccgctcggtatcgaagtgggctggctcgccggtaagcagaaaggtaaagcacggctggcacagcaggaagccatcgccagcggtcaggtgcagatgattgtcggtacacacgccatcttccaggaacaggtgcagtttaacggcctggcgctggtgattatcgacgaacagcatcgttttggcgtgcatcagcgtctggcattgtgggagaaaggccagcagcagggcttccatccgcatcagttgatcatgaccgccacgccgatcccccgcacgctggcaatgactgcgtatgccgatctcgatacctcggtgatagatgagctgccgccaggccgcacgccagtgactacggtcgctattcctgatacccgccgtaccgacatcattgaccgcgtgcaccacgcctgcataactgaaggtcgtcaggcatactgggtttgtacgttgattgaagagtcggaattgctggaagcgcaggcggcggaagctacctgggaagagttgaaactggcgctaccagagttgaacgttggcctggtacacgggcggatgaaacctgccgagaaacaggcggtgatggcgtcgtttaaacaaggtgagctacacctgctggttgccacaaccgttattgaagtcggcgttgatgtgcctaacgccagtctgatgattatcgaaaacccggagcgtctgggtctggcgcagttacaccagctgcgcgggcgcgtaggtcgtggcgcggtggcttctcactgcgtgctgctctacaaaacgccgctttctaaaacggcgcaaattcgcctgcaagtgctgcgcgacagtaacgacggttttgtgattgcgcaaaaagatctggagattcgcggccctggcgaattgttaggcacgcgtcagacgggtaatgctgaatttaaagtggcggatttactgcgcgatcaggcgatgatcccggaagttcagcgcctggcacgccatattcacgaacgttacccacaacaggcaaaagccctgatagaacgctggatgccggagacggaacgttactcgaatgcgtaaaaggcggcagtgagaagaccgccatttcaggttaccctaccttcctgccggatgcgattcatcaccctacaaattcaataaattatgaatcaatacgcaggcttgataagcgaagcgtatcaggcatttgtctttgttgcggcggcacttctaccgccgcttcatcggttaaccggcaaaaatcggcaacatcaaatacaacttaattaccagcgcattgacgatatcgataaagaacgcaccgaccatcggcaccaccaaaaacgccatgtgcgacgggccaaagcgttcagtgatcgcctgcatgttggcgattgccgttggcgttgcaccgaggccaaaaccacagtgacccgcagccagcactgccgcatcgtagtttttgcccatcatgcgccaggtaacgaagatggcatacaacgccatgaagatggtctgtaccaccagaatcgccagcatcggcagcgccagcgaagccagctcccacagtttcagccccatcaacgccatcgccaggaacaacgacaagcttacgttacccagcacggataccgcacgctcaaagacgcggtaaaagcccattattgacagaccgttgctcagaatcacgccaacaaacagtacacagacgaaggtcggcagttcaaaagcagtgccagccaaaagttgcgcaacaattttccccaccgtcaggcagatagcaatcagcgcgatagtttcaatcagcaccaacgaggtgatcatgcgtcccacatccggcttttcaaacgccgtcgggacttcctggtcatccggaataccgttcggcgtggtggagtgtttcaccagatagcgcgccaccggaccgccaatcaagccgcccagcaccagaccgaacgttgcacaggccatcgccacttccgtcgcattggtgaagccataacgttcaatgaacaatttactccacgcagcgcccgtaccgtgaccgccggaaagagtaatagaaccggccaacagccccatcagcggatcaagccctaacaagctagccataccaatgccaatggcattttgcatcaccaacagaccaacaaccacaatcaagaagatgccaaccacacgcccaccggcacgcaaactggcaatgttggcgttcaggccaatggtggcgaagaaagccagcattaacggatcgcgcagggacatatcaaagttgacttcccagcccatgctttttttcagtactagtagcgccagcgccaccaacaaaccacccgcaacaggttccggtatggtgtatttcttcaaaaaggagacggaatggaccaacttacgcccgagcagcaacgtcagcgttgcggcaacaagcgttgctaaagtatcgagatgaaacatagttactcctttgtatccgcatcactctttcatactcgtcatacttcatcgcgcagtggcaacttcatgaactatgacgggtatcgagttatgctttcctgggtcaaattctcagctgttaatgaacaaatggcatggattttaagcagaaaaataccaaaagttatataaaaaagtgcatttatctcatttaaatatttagatgaggatgtggcaaacgtttgcttttctctttcggtcagctaaaatgcccgctttgctaccacgggattgttttcgatgtctgtttccaccctcgagtcagaaaatgcgcaaccggttgcgcagactcaaaacagcgaactgatttaccgtcttgaagatcgtccgccgcttcctcaaaccctgtttgccgcctgtcagcatctgctggcgatgttcgttgcggtgatcacgccagcgctattaatctgccaggcgctgggtttaccggcacaagacacgcaacacattattagtatgtcgctgtttgcctccggtgtggcatcgattattcaaattaaggcctggggtccggttggctccgggctgttgtctattcagggcaccagcttcaactttgttgccccgctgattatgggcggtaccgcgctgaaaaccggtggtgctgatgttcctaccatgatggcggctttgttcggcacgttgatgctggcaagttgcaccgagatggtgatctcccgcgttctgcatctggcgcgccgcattattacgccgctggtttctggcgttgtggtgatgattatcggcctgtcgctaattcaggttgggttaacgtccattggcggcggttacgcagccatgagcgataacaccttcggcgcaccgaaaaatctgctgctggcaggcgtggtcttagccttaattatcctgcttaaccgtcaacgtaacccttacttacgcgtggcctcactggtaattgcgatggcggccggatatgcgctggcgtggtttatgggcatgttgccagaaagcaacgaacctatgacgcaagaactgattatggtgccaacgccgctctattacggtcttggcattgaatggagtctgctgctgccgctgatgctggtctttatgatcacttcgctggaaaccattggcgatatcacggcgacctctgacgtttccgaacagccagtgtccggtccgctgtacatgaaacgcctgaaaggcggcgtgctggcaaacggcctgaactcgtttgtttcggcggtgtttaacaccttcccgaactcctgcttcgggcaaaacaacggagtgatccagttgactggtgttgccagccgctatgtcggttttgtcgtcgcgctgatgttgatcgtgctgggtctgttcccggcagtgagcggttttgtacaacacattccagaaccggttctgggcggcgcaacgcttgtaatgtttggcaccatcgccgcctccggtgtgcgtatcgtttctcgtgagccgctgaaccgtcgggcgattctgattatcgcgctgtcgctggcggttggtctgggcgtgtctcagcagccgctgattttgcagtttgcccctgaatggctgaaaaacctgctctcctccgggatcgccgcgggcggtattactgccatcgtgctgaatctgattttcccaccagaaaaacagtaattcactggcggcggtaagataattaccgccgcagtctcacctctttaaccattcccgccttgaggattgcgcgtaaatcgtgcataactcccttatgtgcatttcacgggatggaagaccatgaaatttattgggaagctgcttctctacattctcatcgctctgttagtggcgatcgctggcctctattttcttctgcaaacccgctggggagcagaacatatcagcgcatgggtttccgagaatagcgactatcatctggccttcggggcgatggatcaccgtttttccgcgccatctcatatcgtgctggagaacgtcacgtttggtcgtgatggccagcccgcgaccctggtggccaaaagtgtcgacattgcgctaagcagtcggcaactgaccgaaccacgccatgtcgataccatcctgctggaaaacgggacgctgaatctcaccgaccagaccgcgccgctaccgttcaaagccgatcgtctgcaactgcgtgatatggcgtttaatagcccgaatagcgaatggaaactgagcgcgcagcgggtaaatggcggcgtagttccgtggtcaccaaaagccggtaaagtgctgggtacgaaggcgcagattcagtttagtgccggatcgctttcgctcaatgatgttcctgccaccaatgtactgattgaaggcagtattgataacgatcgcgttacgctgactaacctgggtgccgacatcgcccgcgggacattaaccggaaacgcgcagcgtaacgccgacggcagctggcaagtggaaaacctgcgcatggcggatatacgtctacaaagcgaaaaatcgctaaccgacttctttgcgccattacgctctgtcccgtcgttgcagattggtcgcctggaagtgatcgatgctcgtttgcaaggtccggactgggcggtgaccgacctcgatctcagcttgcgcaacatgaccttcagtaaagatgactggcagacacaggaaggcaaactgtcgatgaacgctagcgagttcatttatggttcgctgcatttatttgacccgattataaacacggaattttccccgcagggcgtagcgctgcgccagttcaccagccgctgggaagggggtatggtcagaacgtcagggaactggctgcgtgacgggaaaacgttgatccttgatgatgcggcaattgccgggctggaatataccttgccgaaaaactggcaacagttgtggatggaaacgacacccggttggttaaacagcctgcaactgaagagatttagcgccagccgcaatctgatcattgatatcgaccctgacttcccgtggcagctcaccgcgctcgatggttacggtgccaacctgacgctggttaccgatcataaatggggcgtctggagtggctcggcgaatctgaatgccgccgccgcgacattcaatcgtgttgatgttcgtcgcccgtcgctggcgctgaccgccaacagcagcacggtgaatatcagcgaactgagtgcatttactgaaaaaggcattctggaagccaccgccagtgtttcacaaacgccacaacgtcagacacatatcagcctgaatggacgcggtgtgccggtgaatattttgcaacagtggggatggcctgaattaccgttgactggcgacggcaatattcagcttaccgccagtggcgatattcaggccaatgtcccgttgaaacctacggttagcgggcaattgcatgccgtgaacgccgcaaagcagcaagtgactcaaaccatgaatgctggcatcgtttccagcggtgaagttacatcgacggagccggtgcggtaaacatcaatctcgccgggtacgactcagacgtacccggcattccatcaatagattacaacgtaattgtcagcgcattcccttgaggcttcaccaccagcccctgctcactttcagcctgcgaaccgtcttgcagaccatttactttcacaacattgcgcaggcacagtgtccagttcttcgcctcgcccgcaccagtcacagtaatcgtgttgccagtacgtgctgcttttaaagtaaagatcaccgatccgtcagcagcgggcacttcacagacggcttcatgcccgtcttgcagattgaagaggtggaatgccgtgccttcgtgccacacgtaatcgggacgttgatcgttgttgcccagcgccagtagagtgttatcacgcacataaacgggcagactcaggaagccgtgctgctgtttatgccagcgactaccgtcgagttcatcgttgtgccacaggtgtgtccagcgaccttccggcaggtagaactgcacatcgcccgcttcagtgaacaccggcgcaaccatcacgttgtcgcctaacatgtattgacggtcaaggtaatcacaagccggatcgtccgggaactccatcatcatggcccgcatcatcggcgtaccccgcgcgttcgcacgcgcagcttcacgatacagatacggcatcatgcggcatttcagttgcgtgaagaagcgcaccacatcacaggactcatcatcgtaggcccacggcacacgataagatttgctaccgtgtaaacggctatggctggagagcaaaccaaacgcgcaccagcgtttgtaaacgtgcgccggagcggtattttcaaagccgccgatatcgtggctccagaagccaaaacctgaaaggccaatagacaaaccaccgcgcaggctttccgccattgattcgtagttagcgtaacaatcgccaccccagtgtaccgggaatttctgcgcaccgacggaggccgagcgggcaaacaagacagcttcttcctcaccaacggtgtccttgagcacgttccacaccagttcgttgtagatgtacgcataatggttatgcattttctgcggatcggaaccgtcaaaccactgaacatcagttgggatacgttcgccaaagtcggtcttaaagcaatcaacgcccatcgcgaccagacctttcagtttgtcggcgtaccatttgcaggcatccggattggtaaagtcataaatcgccagacctggctgccatttatcccactgccatagcgaaccgtccgggcgtttgagtaaatagcctttctcttgtaactctttaaagacgggggatttttgaccgatataggggttaatccagacgcagattttcagtcctttcgctttcaggcggcggatcatcccttccgggtcagggaaagtcagcgggtcccactcaaaatcgcaccactggaaggctttcatccagaaacagtcaaagtggaaaacatgcagcggcagattgcgttccgccataccatcgataaagctgtttaccgtcgcttcgtcgtagttggtggtaaatgaagtggttagccacaggccgaaggaccacgcgggcggcagcgccggacgaccagtaaagcgggtataacgatcaagtaccgctttcggcgtcgggccgtcgataacaaagtattcgagatattcactctcaacgctgaactgcactttggagactttctccgatcccacttcaaaagagacacactggggatgattgaccagtaccccataaccacggttagtcatgtagaacgggatatttttatacgcctgttcagtacttgtgccgccgtcccggttccaggtctctaccgtctggccattgcgcaccagggcagtaaagcgctctcccagaccgtaaactgtttcgccaacgccaagatcaagccgctcaaacatataattgcgttgattattcgtgtcctgcacgtagccattatttttcacctgactaccggtaatacgttcgccgttgcgcagaaaatccagtgaccagaactcacctttgctgacacgcgcgcttaagttgccacttttaaactcagcataacgttctgtgttttcgattgtgaccttcacgtcctgcaaaatattgagcggataatgaggaccgttattcagcgccccctgaaaatgctcaatccgcacaccgacaataccttcctgtggggagaaaaagcgcaacgtaaataaaggcgtatcaagctgccaggtacgttcacgcacatcacggggggcagcatagaccaccatttcattatcctgctgttcaacctcgaacacctgaagcgggtgaatcaaattgaggccaggttgaatcaaccagtttccatcgctaattttcattgccgttccttagttctgcacttcttgagaggtgaattgttgctggcaacggcgtttaccctgagccagctgttccataacggttttcagattgtgcgtcgtgagtgagtagtagcgtttagcgataatcgcgctcagcaaataacagatcgccggaacaatcgtgaatagcgcaataatgatgctaatcgtggcgctgttctgcgctttttctgccgcatcatatccgccataagccagcatccagccgataagagcgccgccgaaggccaaccccagtttgagcacaaacagcgtgccagcaaaactgatcccggtcaggcgtttaccattgcaccactcgccgtagtcgacggtatcggacatcattacccactggataggtgtcaccagttgatgcaacacaccaatcacgaagatgaagacaaacatagtgatgctggcctgcatgggaacaaagaacatcgcgaggctaatcactgccagcagggcgttcgtccaccagaagatagtgactttacatttccagtcggtcagaggttttgccagtgcggaaccaatcaggttacccacgcaataagtggtgagaaaagcgacaaacacttccggcgtgcccaaaatccatgtgacgtaatacatcatcgccccaccgcgtacgcacaccgccaggatattgaaaatggttagtaaaccgacaatccgccactggtcgttttgccagatatcacgtaaatcttcccgcatagacgttgttgtaggtggtgcttcaacgcgttctttagtggtgaagaaacaaaatgccagcatcatgaatgccaccacggaaaggaccgcgataccgccctggaaaccgagtggtttattatcaccgccaattaaattaaccagtggcatcatcagaacagtagaaagcatgcctcccgcggtcgccagcacaaaacgccaggattgcagcgagatacgctgagtcgggtcattggtgattacaccacccaatgcgcagtaagggatattgacgacggtataaagtaaggtaagtagggtgtaagtaattgctgcatagatcattttgccgttcatactgagatctggcgtgctataggccagtacacagacgatcccgaatggcagtgcgccaaacagtacccacggacgaaatttaccccagcgagagcgcgttcgatcggccaacaaccccatgcaaggatcggaaatcgcatccagtgcacgagcgaccaaaaacatggttccgacaaaaccggcaggaatgccaaaaatatcggtataaaagaacatcatatataacattacgttatcgaaaataatgtggctggcggcgtctcccatgccataaccaattttctctttaacggacaacacttcactcttcatctgcttttccttgatgctataggggtgctgagaccgataacgcattttgtaaaccatccctgtgagagcgaatattccgatatctggttattaatttatgattcttgttttatgtgatcgtggtagcgttaattccgctcatatatcattgtaaaatatgggttttatatgaactataatgctttcgtgataatacgctgcgtgtattaggcggaaaaaactgatctgggggatgtagaaactcaaggaagtagctataatgcgccccgcctccatgtagcaatcgaggcgcggaagatcgtcgtctccggtgaggcggctggacttcaaatccagttggggccgccagcggtcccgggcaggttcgactcctgtgatcttccgccaaaatgcctctcctgacgttctccaaccccttgtaatactgtcaatccagatattttctactgctcaatattcaatcggcttcaggaatacctggtctaaggttttgtgatggacgatgagcggctgaagaatccgcctgtcggttcttctgtcctcgaacgcatccgcgatattcacgccagtatgcgccgtgtttatttgcaggtgatttgcccccctgctgactctcagccaactgtatcgccattaaggtgaagatgttgttttactcgccccagaacacccttttttatacgactattctatttctttaaccgctggcgaaaaaaactgactataaacttcaccaataatcagactgccatcaagattaatttgttcatttaatatatcaaatcaacttgttttatttttactatcaaaaatagctcattgccttactataattaatatataaattcggtaattaattcttaacatgcttttactaataatctcaattgctggccctataatattgcgctagcattgctttctggttgtatcagcgatactcaaaaattcttaatacaatactcattcgactggtacttatttgtaactcagttatattttttcgcccggtgattcagaagaatgcaaaaaacggctaccactccatcaaaaatacttgatctcactgccgcggcatttttacttgtcgcctttctgacgggtattgcgggcgctcttcagactcctaccctaagtatattcctcgcagatgaactgaaagcccgtcctataatggtaggttttttcttcaccggtagcgctattatgggaattctggtcagtcaatttctggcaaggcactccgataaacaaggcgaccgtaaattactgattctgctatgttgcttatttggagtgctggcctgcacgctttttgcgtggaatcgcaactacttcattctcctctcaacgggcgtacttctgagtagttttgcttccaccgcaaacccgcaaatgttcgccctcgcccgtgaacacgccgacagaacaggccgtgagacggtcatgttcagtacatttttacgtgctcagatctcgcttgcctgggttatcgggccaccgctcgcttatgaactggcaatgggatttagttttaaagtgatgtatctcaccgctgccatcgcatttgttgtttgcggactgatagtctggttgtttttgccatcaatacaaagaaatattcctgtcgttacccaacccgtagaaattttaccctccacccacaggaagcgggatacgcggctactttttgtggtctgttcaatgatgtgggcggcgaataatctctacatgataaatatgccgctatttattattgatgaactgcatctaaccgataaactgactggagaaatgattggtatcgctgccggtctggaaattccgatgatgttaatcgcaggctattacatgaaacgtattggcaagcgactattaatgctcattgctatcgtgagtggaatgtgtttttacgccagcgtactcatggcgacgactccggcggttgagctggaattgcaaattcttaatgccatcttccttggtattctctgtggtatcggcatgctttattttcaggacttgatgcctgaaaaaataggctctgcgacaacgttatatgcaaatacttcacgcgtcggctggattatcgccggctctgttgacggaattatggttgaaatctggagctaccatgcgttgttctggctggcgatagggatgttgggtattgcgatgatttgcctgctgtttattaaagatatttagctcaccagtctgggctaagaaaaatcggcgtggcgcaaacagagccatcctcgccatttttgctatcatgcctgcatacataaacgacaaaacagtatgcagagggaaaaatgggttccaccagaaaggggatgctgaacgttctgattgccgccgtgttgtggggaagttcaggggtctgcgcgcaatacatcatggagcaaagccagatgtcgtcgcagtttttgactatgacgcgtttgatattcgccggtttgattctactgacgctgtcatttgttcatggcgataaaatcttttctattattaacaatcataaagatgccattagcctgctgattttttccgtggttggcgcgctaactgtacagctcacttttttgctaaccatcgaaaaatcgaacgcagccacggcaacggtgctgcaattcctctcaccgacgattatcgtcgcctggttctcactggtgcgtaaatcgcgcccgggcattctggttttctgcgctattttgacatcgctggtcgggacttttttattggtgacacacggtaatccgacgtcattatcgatctctcctgccgcgttgttctggggcattgcctcggcatttgctgctgcattctataccacctatccctcaacgctaattgcccgctatggcacgttaccagtcgtcggctggagtatgctgattggcggtctgattctgttgcctttttatgccagacaaggaacaaactttgtcgttaacggcagtttgattctggcgtttttttatttggtggtcattggtacgtccctgacatttagtctgtacctgaaaggagcacaattaattggcggtccaaaagccagcattttgagctgtgcagaaccattaagtagcgcgctactctctttgctgttgctggggatcacgttcacattaccggactggctgggaacgctgctgattctgtcatcggtgattttgatttcaatggattcccgtcgccgcgccagaaaaataaatcgtccggcgcggcataagtgagaattaccagccaggcaccgcgccaccgttaaaaatggtttctgccgctttagcgacttcgggtgattgataagattgcagaaattccttcacgttttctgcattcttattatcttcccgtgccaccaaaatattcacatacggcgaattcttatcttcaataaatacgctgtcgtgcaccggagaaagcccggtctgctgaatgtaagtggtgctgataatcgctacatcaactttgggatcatccagtacgcgcgggagctgcgccccctcgagttccataatctgcaaatgacgaggattatcggttatatccagcgcggtaggtaataacccttttccctctttcagagtaattagcttctctttttgcaacagtaaaagtgcgcgaccaaggttggtcgggtcgttggggatcgccactgtcgcgccttcttttatttgcgccacggttttgatttttttggaataacccgccatagggaagacaaacgtatttcccaccgctaccagtttataaccatgcgcctgattatcttgttcaagaaagggtcgatgctggaagacattcgcatcaagttcgccatgatttgtcgcatcgttcggtagcaacgaaccgctaaatcctaccagttcaacatcgaggccatatttctcttttgccacctttttagcgacttccgcgacatcttgttctgcgccatttataacgccaactttaatgtgttttgcatcgctgctactctggtcgcaacctgccagcagaattccggccagcaataatgcggcccctgtccgtagatgatgtgttgtcagtttcatttttttatccttttattaatgattacctgactatagcggtaaggtcgctgcggtttaaaaaacgaaacgctatcgataagaataaaaaggaataaaagtggaatataaagtctggcacttcttactgaccacgcaagcgcgtttcgtacagcatgatgagagcgatgaaagcaaactacacttatgcttcattcgatacacatttgtaaaaggttgaatccatgaaaccaacgacactactgcttattttcacttttttcgctatgccaggcatcgtatacgccgagtcgccttttagctcactgcagtccgcaaaagagaaaaccacggtattacaagatttacgtaaaatttgcacgccacaggcgtcattatcagatgaagcgtgggaaaagttaatgttgtcagatgaaaacaataaacaacatatacgcgaggccatcgtggcgatggaacgtaataatcagagcaattattgggaagcgttgggtaaggtagaatgcccggatatgtaagaacagcaacaactactgaccaacgcttctttacctgatatcaggatttcttcattttcacctttgcagtaaccaacaatgcagtcagcaacatcaatgtgccggacaacatcaacggcgaagtcagaccaatattatccagcgcataaccgccgattgccgcgccacaggtattagcaagctgaataaccgccacctgaatagacccggctttttctgcctgatcggccagcgagcgggtgatccacgttgaccagccgacgggaaccaatgcaaaagttagcccccagataatcgccacgccggtagcaacgattttatcgcttccccacaacgtcagtaccaacgcactcacagccagtattaacggcgcgcctgctaaggccagttttaccgaacgtttaagaatgaacgacgaaagcgacgtaccaataaagctggcgataccaaaactcaacagcaccagcgttaagccatccacgccgaatcccgccaggttcatatacaccgggcgaatatacgtgaagaaagcaaactgcccggcgaaagacatgaagatggcgatcatccctgccatcacacccggacgttgtaataagcggaaagtattttgtttctgatgcgagggttcgcctggcagtgaaggcaatgatttgataatccagaaaatacacagcacgcccatcaccgccgccgcattaaagacattgcgccaaccgataagctcgcctaaaaaactgcccaacggcgcggcaatcaccagcgcaatagaaaccgcgccgaagatcaccgacagcgccttcggcaccgtacgcggcggcaccagacgcatggtcagcgacgccgacatcgcccagaacccgcccagcgccagccccagacaggcacgaccgattaaaagcaaactgaatgagttagcaaaggaaaccagcaagcaggagagcgtcagcaaaacggcaaacaaaataacaacgtagcggcggtcagtagcctgaattgtctgggtaataaacaaactggcaaacattgccacaaaggcggtcacggtcaccgattgcccggcaaccccttccgaaatgcctaaatcctgggccattggcgtcaacaaactgacgggcaaaaactcaacgataatcagacaggcgacacaaaacgccaccgagaaaacggctgaccagttcggtcgggtgatggcatccgcgccgcggttttcggcaataaattcactcatggtgttacccgtggcatgtttcaggggaaaagccgaccactttaacattgaaatgtgtgacgcatttaacgtttttgcaacttttacggtgttgcttgagctggagttaagatcgaaacggaacagggcaaagattaccggatgcggcgtgaacgtcttatccacccgacaggtcaggcgcggtctgtaggctgataagacgaaacggtttcaatgcaaccagtgaacgccctcggcaggctgaaagaacgcgttatagcgcatctgaaaagcattaatatcctgcatttcaggttcggtttcgcgcagaaaacctagcgccagcctgacctgagcgtcggtaatcggcgcggcgaggcgagctttttgtaaaatccgatgccattgcagcaggttctgttcgctaccatcgacaatgacaatttgccagatgagcaacacctgcgcggcgttttgcaggtgcgactcatccggacgatgcaaataacgtaaaaattcgtcaccagctgactttcccatttgatcgaccatcgactccacgggtacgacatcgatgttcagccgatcgctgagacggcgaatcgcttttctggccccggatgtcagcacccgaaaaccaaccacaaacactaccgccagcgtggcgagcattatccagatcatgagttctcctgcgtaatcagaactcatgatatctggaaaccctcgccagttactaatccaccagaataatcttcagtgcaaacagagctgcgaccaccaccacacacaggttcagatcgcgccagcgcccggtgcatactttcatgatgcagtacgacataaagccgagtgcaatcccttcggtgatcgagaaagtaaagggcatcatcaccgtggtaataaacgcaggcaccgattcggtaaaatcatcccagttaacgcgcgccaggctcgaagtcatcagcacgccaacaaagattaacgctccggcggttgcgtaaggaggaactatcgccaccagcggtgagaagaacataaccaacaggaacataacgccaaccacaaccgcagtcagccccgtgcggccaccgactgccacaccagaagtactttcaatataggcagtaacagacgaggtgccgataaacgcacccgccaccgaactgacgctatcaacatacagcgccttattcatattggggaatttaccgttaccatctattaagcccgctttatcagttacaccaattaatgttcctgatgaatcaaataggttgatcagcataaaggagaaaatgataccggcgagttcaagtgttaacgcgccgctcaaatctacttcaccaatgacgccgctaatatcaggcggaatggaatagacgccgctaaaatgaacatcaccgaaaaataatccacagcaagacgtcaccacaatagaaaccagcaccgcggcatgaaaatgacgtgatgacaacacggttataataaaaaaccctaaaatacctaacaacacgccgtgagaacttaaatcgccaatcatcaccagcgtgtctttattggcgacaataacgccagtattttttaatcccattaaggcgataaataatccaattccgctggtgataccaatacgtaaacttaagggaatgttggagatcatccagtaccggatacgaaacagcgtgagcaaaaatagtccaactgcgccccagaatattgcgcccatcccggtctgccaggagatgcccatcgcccccacgaccacgaaggcaaagaaggcgttcagccccattgccggagccagcgccacgggtaagttagcaaatatccccatcgcaatactgccgataccggcaatcaaacaggtggtaacaaacaccactttcgggtccatttgtgccgcgccgaggatttgcgggttcacaaaaacgatgtacaccatggttaaaaaagtggtcatccccgcaatcaattctgtgcggacggtggtcccatgctgaggtagtttaaataatcgcgaaagcgtccctgattcattactcacgtaatcggtattgtcattattcatttttttgtccattggaggagatttaatcccttgcttttgtaaaacaaatgacaacaacggttcagtgataattatcacatttcaattgcacattaatggatattctttaataatctcgcgacgtttctttatgataaataataatcaaattgataaaatcaaaatgagaaaaatatgaataattctattaaccataaatttcatcacattagccgggctgaataccaggaattgttagccgtttcccgtggcgacgctgttgccgattatattattgataatgtctctattctcgacctgatcaatggcggagaaatttccggcccaattgtgattaaaggacgttacattgccggtgttggcgcagaatacactgatgctccggctttgcagcggattgatgctcgcggcgcaacggcggtgccagggtttattgatgctcacctgcatattgaatccagcatgatgacgccggtcacttttgaaaccgctaccctgccgcgcggcctgacgaccgttatttgcgaccctcatgaaatcgtcaacgtgatgggcgaagccggattcgcctggtttgcccgctgtgccgaacaggcaaggcaaaaccagtacttacaggtcagctcttgcgtacccgccctggaaggctgcgatgttaacggtgccagttttacccttgaacagatgctcgcctggcgggaccatccgcaggttaccggccttgcagaaatgatggactaccctggcgtaattagcgggcagaatgcgctgctcgataaactggatgcatttcgccacctgacgctggacggtcactgcccgggtttgggtggtaaagaacttaacgcctatattactgcgggtattgaaaactgccacgaaagttatcagctggaagaaggacgccggaaattacaactcggcatgtcgttgatgatccgcgaagggtccgctgcccgcaatctcaacgcgctggcaccgttgatcaacgaatttaacagcccgcaatgcatgctctgtaccgatgaccgtaacccgtgggagatcgcccatgaaggacacatcgatgccttaattcgccgcctgatcgaacaacacaatgtgccgctgcatgtggcatatcgcgtcgccagctggtcgacggcgcgccactttggtctgaatcacctcggcttactggcacccggcaagcaggccgatatcgtcctgttgagcgatgcgcgtaaggtcacggtgcagcaggtactggtgaaaggcgagccgattgatgcgcaaaccttacaggcggaagagtcggcgagactggcacaatccgctccgccatatggcaacaccattgcccgccagccagtttccgccagcgactttgccctgcaatttacgcccggaaaacgctatcgggtcattgacgtcatccataacgaattgattacgcactcccactccagcgtctacagcgaaaatggttttgatcgcgatgatgtgagctttattgccgtacttgagcgttacgggcaacggctggctccggcttgtggtttgcttggcggctttggactgaatgaaggtgcgctggctgcgacggtcagccatgacagccataatattgtggtgatcggtcgcagtgccgaagagatggcgctggcggtcaatcaggtgattcaggatggcggcgggctgtgcgtggtacgtaacggccaggtacaaagtcatctgccgttacccattgccgggctgatgagcaccgacacggcgcagtcgctggcggaacaaattgacgccttgaaagccgccgcccgtgaatgcggtccgttacccgatgagccgtttattcagatggcgtttctttctctgccagtgatccccgcgctaaaactaaccagtcaggggctatttgatggcgagaagtttgccttcactacgctggaagtcacggaataataaaaaaagcccggcgtcatgccgggcaaaagtcaccagttacgtttatgccactgtcaactgctgaatttttttctcgcggcggattttgcgttcttccattaccgccactatcgccatcaggcagatacaaccaatcgcggcgatatccagcgcggcgaaggtgcctgcccagccggtaaggccgaataccggcgtcccatcggcaatcattcccagacctaacttggcaaagctgtcaccaatcaggtaagcaaaggtgcctttaataccatcggcagcgccaatcgcttttttaggtacaaagccaacagcagccacaccaatcaacaattgcgggccaaagaccaggaaacccaacgcaaagagagaagccagatagatatattcgttactggcatgttgatacacaccgagcgtggcgataatcagcgccagcgcgatgcaggccaccaggccacggcgaccgttcgccaggtcagagagccagccccacagcagcgtaccgaccagcgcaccagcttcaaacagcgtaaagccctgaatcgccaccgctttagagagtttcagttcctggaacgcgtatacggttgaccactggtcgataccaatacgtaccacatagaggaaaatgttggcgaagcacagcagccagatcactttgtttttcagcacatactcaacaaagatctgccacttggtcatatcggtagattctgtctctttgtcctcttcgctgatctcctcgccgaacagttcttcagctttgccgaggccataagattccggggagtcgctgccgtaacgcaggccgataaaaccgacaatcagcgcgataatcgacgggaagataaacatgccgatgacatggccatcgaacaggtaatttgccccgaacagcgccacacctgctgcgcctgcaccgccaaggttgtgagaaatattccagaaaccgaggaatgtcccgcgtttacgacgcggcgtccatttggtgatggtggagtaactgcacgaaccgccggtactctggaaaaagccgcttaaggcgtagaaggcaatcatcaggaacaggctaaccgagccgctgcccatactggcactgaagcccagcatacaaatagcagagaggatcagcatgaacggcaggaattgtttggtgtttttgccgtcggcgtagtaggaaaccagcgttttacccacgccataagtgatggagaaacccaggccgatcatccccagctgcgtcatgctcaacccgtaggtcgaaatcatatcgttctgcgcgatgttaaagttcttgcgaatcaggtacatcgtcaggtagccgataaagaccaccaggtaggattgcatgaacggtttgaaccacattttgcgccgcacttcgagcggaaggtccagggtcggcttgcgaacctggtttaagaaagccagcatgggttactcctgaaatgaatacctgcgtgaggcatgcattgtaaaaatcagcagcaaatcaggcctgagatagcgtccaggcaaaacctggaaaatttcttagttttgccggatatgaagtgaaaaggtgagatgcatcacgcttcgcgcggtgtctgggcgttcaaaaagggcagtaacagcagtgcggaaatcccggcggcgatagagataaccacaaaaaatccgctccagtgccaggtatcgagtactttcgccagcggccaaccagcaagcgacgcccccagataagcaaacaagccgacaaaccccgtcgccgcccctgccgcctctttgtgggaacactctgccgccgccataccgattaacatctgtgggccaaagacaaaaaaaccaatggtgaagaagcaggttgcctgcatcacgtagctggcaaatggcatcagccacagggagccgactgaaagcaaaattccggcggcgaaaatcaaattcatcggccctcggttgccgttaaacaatttgtccgagccccaaccggctaccagcgcaccgataaatccgcccagttcaaacatcgtcactgccgtattcgccgtgaccagatcgacgcccagtgtctcggacatatacaaattgccccagtcgttgatcgccgcccggaccacatagaccagcacatagcaaaacgaaagcagccagatatacggattcagcaacacatatttggtgaggatctctttacgcgtcaaccctgccccttcttgttgttgagcaatttccagcgcgtcgtgtcgccattcaccgaccgccggtaaacctaacgcctgcgggcgatcgcgtagccgccagcagagaaaaatccccacgactatcgccatacaaccagcaatcatcatcccggcacgccagccgtaatgcagcgcagccgctgccatcacaatgggaatgagtgcgccgccgacgttatgcgccgtgttccataatgcccaccaaccgccgcgctcggtacgtgaataccaggccgttaacagacgcgcacacaccggtgaaccccagccctggaaaaaggcgttcagcacccagagcacggcaaacgcccatagcgacgtcgagaagccaaacagaatgttgataatgcccgtggcgataagccctatccccataaaataacgggcatttgagcgatcgctgacaatgccggagacaaacttcgacacgccataggtaatgtaaaacagggtcgctaacaggccgatatcgctacggctgagcacgccgttagcaaggatttctggtacggcggcgttaaaacttttccgcgtgaagtaaaacagcgcgtaacccagccagatggtcagcagaatatgccgacgccagtagcgatagcgggcatcaatttcatatttatcagtcattaatggcgcatcggcaggcgctttcagaaacggcaacatcatcaaaccttagacatagcgttgaggtagagaaacgctgacacgcgtgccgtgcagacaggaaatgtgtaatgtgccacccagcgccgttacgcgctcgcgcattccggtgaggccaaaaccttgttgcccggaacccggcggcaaaccgctgccatcgtcttcaataaccagcatcaaccgttcatcctgctgccagccttgcagggtgaccgcgctggcatcagcatgtttcacaatgttgttcagcccttcctggcagacacgaaacagcgtcacgcgctggttttcgcttaacgctgattcatcgattcgccattcgagatggctgacaataccgcgcccttccagctccatttcccgcatcagtgagcggatggcctgctccagggtgagatcatccaactggcgcggacgtaaccgacccaacaaacggcgcaccgcgtcgtaaacgcccagcgatagttgttcgatgagctgcccgctctgcttcacgctggcgttatctgccgccagccgctgaacaatgcccgcctgagtacgaatagcagtgatggtctgaccgatatcatcatgcagctcacgcgccacatcacggcgcacgctctcttcggtttccagcaaccgttcagccagatgctgattgcgcgccagttccttttgcagcgactggttaagttcacgcaaccgctggatgccagcgccaagcaacaaccctgtcagactttgcaccagcagcgagagcaataaatccaccggatgatcgcgccaggtttgactggcgatcagcgcgatggcgttcatcaacgtcgcaatcagcgccccttgccaaccatagtgccaggccagcgcgataatcggcagcgccagacagaatggcgtaaagcgcgacagttcgtccggcaatcccaactggagccagagactgataacaaacagcagcaagtaccagaccagatgtcgcccgcgccagttgattggctgagaaaccagtgacggaccgagcggcagccaggtgttattggcgagatagtgccagaacaccagacatatcggggccagcgtcaggccgccagttaaagtcagcaacagcgcattccacgactctttgccgtgccaaagccagggcagcgactgcaacaacgccgccgccgttaacgccgccccctgtaacagcaaggtgcgccagtcacgctgatggcgatagcgcgagatcagcgctacgggcagtaacgtcagtaaactaccgatcatcaataacggaaaatgggttaaaccgaccgcctgcgttagccagtaaatcagcagccactccgcgcccagcaatacgggccagtatccgcgcgggcattgcagcattagccccagacgcagaccaaacggaaataacagcaccgccatatcagggcgctcaaccagatgcaggctgatactccacaggcaaaaccatgcggcagagaagataaaaaagcaggcaataacggtaattaagcgggagaacaacgtcttcatcaccagccatcaaacatgcggcgcgccagctctacgtcgttactgacgcccagtttttccatcagattggcgcgatggacgtgtaccgttttcggtgacaagcccagttcggcggcaatctctttcaccgccattccttgcgccagtttttccgccacctggcgttcacgtttggttagcgggtcctgacgaccggatgccagtttaatggcaatatccggcgtcagataacagccgcccgtggcaaccgtatgcaccgcagcaatgagttcatccgggctacagcgtttggaaagaaagccgcgtgcccccgcgttaagcgcctgctcaaccagcgcaggactgtcgtgaacggagagcataatcgtcgccatacctttcggcagctggcttagcagctccagaccggagatatcgggcatggagatatcgcaaatacacacctgcacaccgcgccccggcagccccgccagcgcctcgcgccccgaaccaaactcggcaactacctgcaaatcaggttccagccccagcagctgcgcaaagccggagcggacgatgaggtgatcgtctataagggcaacggtgatcatggtcttgtcctggcgggtaaaaaaaatacgcgcttaccttaacgataagcgcgatgttgttcaagccttgagcggttactgaaaaaacaccgcgatcttgttaaacatcgtcggatcggactgattacgctgcactttcacgacatcttccagcttatcgatttggcttatcatctgctccagacgctggtcgtcattgaccagtagccagatatggcttttgtcgctgtcctgaatcggcagacaaagaatgccttcaacgttaaaagcgcggcgggcaaaaaggccacaaacgtgggtcattacgcccggatggttgcgaacggtgagctccagaattacgttgtcatgagttgtgttttgcatggcttattcccccaccatttcagtattcgccgcacctggcggcaccatcgggtaaactttttcttcggcatcaatgcgcacatggatcagcgccgggccagggcgattgatgatttcctgcaatgaagcctgcggatcggcttcgttattcaaatcacaggtttcgaggccgaatccggcggcaatctgcataaagttgattttgcccggataggtggcggcaaaaacgccttgctcgtagaacagactctgttgctgatgcaccagccccagcgcttcgttgttcatcagaatgattttgacatccagctgattttcactggcggtcgccatctcctgaatattcatcatcaggctgccgtcgccggagaaacacaacactttgcgatccgggttcgccagcgcagcgccaatcgccgcaggcaggccaaaacccatcgtgcccagcccaccggaggtcagccactggcgtgggcgattgagcggataagcttgcgcggtccacatctgatgctgaccaacgtcggtggtgataattgcattgtcatcgacacaggcggcaacggcgttgatcaggccgtaatggcttaacggatcgcacgctttcgggattggacacggaaactcacgctgcaaatccgctaccaactggtgccactctgcacgcggttgcgcttccaccagcgggatcaactgcgccagcacgtcatcaacatccgcctgaatcgccacgtgcggctgcttgattttacccagctctgcacggtcgatatcgacatgaatgattttggcattcggacagaactgctcggttttgccaatcgcccggtcatcaaaacgcgcaccgagcactatcaacaaatccgcctcctgcaaaatatagttggtgctgcgcacgccgtgcatccccagcatacccagcgacaacggatgcgcttttggcaacatgcccagcgccattaaagtcatggtggtaggcagttgcgctttctccgccagttcacgcacccgtgcgggcgcattgatcacaccgccgcccagataaagcaccgggcgtttggcagcgttaatcatcgccgctgcgtcacgaatgctttcttcgctaaaggcgggggcggcggctttttctgccatagcgggctgtgtttcaatctcaaaaactgccgtttgcacatccttaggaatgtctatccacaccgggcctgggcggcctgattgcgcaatgcggaaggcatcgctcatgacctgcgggagttcttcgatatgtctgaccagatagttgtgtttggtgatggggatagagatgccgtaggtgtccacttcctggaaggcgtcggtgccgatcatcgaggcgggaacctgaccagtgatgcaaatcagcgggatggagtccagccgcgcatcggcaatggcggtcaccaggttagtcgcacccggtccgctacaggccatacagaccgccggtttaccgtcggtgcgcgccattccctgagcgataaagcccgcgccctgttcatgacgggccagaatatggcggatttgcgtgctttggcttaaggcatcgtaaacaggcaggatagaaccgcccggaatgcctgtcacaatcttaatgccctgctgttccaggaaatgaacgataaattctgcgccggtaaagcgcttacgcgtcgatgttgtgcccgaacttgccatgctccagtccttttcttctgggccgactttccgggaggtgcttaaacgaaaaaccccgcccggtttgcgccggcggggttttggaatcgtgtgttgttccagtccctacggcgcattgccgacgaccaccaccacacgcacgacgaccactgcggcggatggcgcagttggtagtagttttgcgttgagcatggaagtagtcattggggaccttgttggttttgtgtttaacaatatttatacaagcacagctttacaggggagacaatggaaaatttttcagcaagggaaaattgaggggttgatcacgttttgtactgaattgcagataacaaaaaaccccgccggagcgaggtttcgtcagtcgcctgcggctggtaaccgcaaagcacactgtattatgtcaacactgaaagtatacgtgttccgcgcagaacgcgcaatttcggcacgaattttgacgtatttagtgcatagttgagtatcgatcacagtttgcgttttgtccaaatattactgtttatttatacagtaaacttctataatatcactgtacgcaatgtgttatgcgggggccgcatcgttacccggcgcactaagtcctggctgaaacgggtggtgccgtcagcgccttaaccccgcgtgagcacactgtgttatgtcaacaagcacaacgtttctccttgagataccgcgtgcacaacagctggcaacaggcagcggaaaggtacgtcagctggcagtgctcctgaaccacaggagacgcgtatgaacctggtggatatcgccattcttatcctcaaactcattgttgcagcactgcaactgcttgatgctgttctgaaatacctgaagtaattcagattcaagtcgcaccaaaggggagcgggaaaccgctccccttttatatttagcgtgcgggttggtgtcggatgcgatgctgacgcatcttatccgccctaccatctctcccggcaacatttattgccgcttttgtttacatattctgccgctaaacaattccccattcctggcgtatatctggctaacattcatcaatgtgatagattcctctcccgcatttatgggaatgcgtagtgacttattctaattatttttataaaagcatccgtgataatgaaaaggcaaagaaacgtcaatttgttattgatgttggtattactcgtggccgtcggtcagatggcgcaaaccatttatattccagctattgccgatatggcgcgcgatctcaacgtccgtgaaggggcggtgcagagcgtaatgggcgcttatctgctgacttacggtgtctcacagctgttttatggcccgatttccgaccgcgtgggccgccgaccggtgatcctcgtcggaatgtccatttttatgctggcaacgctggtcgcggtcacgacctccagtttgacggtgttgattgccgccagcgcgatgcaggggatgggcaccggcgttggcggcgtaatggcgcgtactttaccgcgagatttatatgaacggacacagttgcgccatgctaacagcctgttaaacatggggattctcgtcagtccgttgctcgcaccgctaatcggcggtctgctggatacgatgtggaactggcgcgcctgttatctctttttgttggttctttgtgctggtgtgaccttcagtatggcccgctggatgccggaaacgcgtccggtcgatgcaccgcgcacgcgcctgcttaccagttataaaacgcttttcggtaacagcggttttaactgttatttgctgatgctgattggcggtctggccgggattgccgcctttgaagcctgctccggcgtgctgatgggcgcggtgttagggctgagcagtatgacggtcagtattttgtttattctgccgattccggcagcgttttttggcgcatggtttgccggacgtcccaataaacgcttctccacgttaatgtggcagtcggttatctgctgcctgctggctggcttgctgatgtggatccccgactggtttggcgtgatgaatgtctggacgctgctcgttcccgccgcgctgttctttttcggtgccgggatgctgtttccgctggcgaccagcggcgcgatggagccgttccccttcctggcgggcacggctggcgcgctggtcggcggtctgcaaaacattggttccggcgtgctggcgtcgctctctgcgatgttgccgcaaaccggtcagggcagcctggggttgttgatgaccttaatgggattgttgatcgtgctgtgctggctgccgctggcgacgcggatgtcgcatcaggggcagcccgtttaagcgcacgtcaccgcagcatcgtcatcagctccatgggagaacgatgctgctttatcagatcacgcatcacccgcatatgcggtgcggagtaagaataaaacgcctgatagcccgcacaaagcacgctgtctggcgtctcctgccgagcgtgcgggcacaggcgatgccagtcgcacgcctggcagtcacagcgcggttgcgggttttcgctgccacaccatttttgtaaggtggcgtcaaaaagctcaatcgagatacgactgatatctgcccgcacccaacactcgaacagggcaattaaaaatttcccccacagctctgctgtcaccgaagcggccgtcagatcgccccggtcatcaaattcaagatagggaatgagctgtacggagcggatgccccgctgtttgaaattgtgataaaaatcggcaggttgcagagcatccttgtactctacaaccagtttatgcctgtcctcttcagcatcaatgacctgacttcctgtcatgcgactctctcaataaatacgataagttgatgtatatgcgttacagcaaacagtattgcgagagataacaccgcgagggagatcaaaaatttgtcacggactacgtgaaattgggaaaaatcgctattcgtgacatccattaaattgcgattacgggtgtagtgccagaggatcagcgccacgatggcgagaatgccaatcgaaatccagaataacatgcccgcctggtgccagttgtgtttgatagccaacgccatcaacgcgccgtagcccagcatggtacgaaaccacgccagtgatgtgcgctccggctgcagtcctgggtcggcaatgcgtctggctttgcggctatccggcatacaacaccagtcccataacgatcaccgccacgaccatcaatattaagctaatgattaataagctgttggtgtagggcaggtcctctttcagacgcatcgctttttcattgcgtaaccagcgcaagtagccatacatcgctaacccgccggaaaacagacacaacaacaacgccagcagttcgcgaatgacgggcgtggcgaaatctggcgcaagttgatcaagcccaacccccgccgccagaaatcctagtgcagtacggatccacgccagaaaagtacgctcattagccagcgagaagcggtaatcaggcgcttctccgaggcgggaaattttcattgttgctcctttgcaatttcactaacgctctacctttagcggtttttttaagaatttcgtccgcccgtttcctgatatgcttttgccatccgctacaaggaggtcagatgggtatcatagctcaaaataaaatcagttcattgggcatgctgttcggtgccatcgctttaatgatggggattatccacttttcattcggccctttctccgcaccaccgccaacgtttgaaagcatcgtggcggacaaaacggctgaaattaaaagaggtcttctcgccggaataaaaggcgaaaaaattaccaccgtggagaaaaaagaggacgtagatgtcgataaaatcctcaatcaaagcggtatcgcactggccattgctgcgctactttgcgcatttattggcggtatgcgtaaggaaaatcgctggggcattcgcggcgcgctggtttttggcggcgggacgctggctttccataccttgctttttggtatcggcatcgtgtgcagcattttgctgatattccttatcttttccttcctgaccggcggttcactggtttaagcagcctgaataatgcccgccgggtgatcatcagcgggcattatcgtcagaacttctgttttttctcctccaccttcaccccttgtgtcggtaggccggtgtcatagtcgcgtacaactggcgaatagccatcttgtggacgtggacgaaacgcccccatccagcgcggccgtgcatctttacgccacggacgcagactccattggtaactgcggaacggatcgcgaattttgtccatgtaatccaataaggcgtcatgcattttgctgcgaacgtctgcaaaacggatatcatcgatcaggttatgcatttcatttgggtcattacggcgatcgtaaagttcatcactggtgaagaggttgagtaccagtttaaagtcatccgtcacccagcaacgcaccggaataaaaccgccaaagctgtcatgctcaatctcgtagcggttaaattccaccatcacgccgcgtggctctttcacggcaaggatattttcccccggcagaatctctggtttttcaatatctgccagcgccatcattgtcggcagtaaatcgatatgactgactggcgtatcgacctgtcgccgctccccttgcggcgaacggatgatcagcggaatgcgggtgatgtcgtcatacatcgccgcccctttactgatcagcttatgtgcgcccatcatttcgccgtgatcggaggtataaataacccacgtattttcacgttgctctggcgttaaggcattgatgacccgtccgatttggtcatcaacaaagtcattacaggcaaaatagagcggatggtgataaagcccgtcatcaccgactggcgatggcatcgcctgcgcccataagcggtgatgttccggtttgttagccaggtcatcctgtgctttctcgcccagctcgtagtaaaaatcagcgtatttctctaaatactccaccggacaggtgaacgggtgatgcggctcatcatacgaaaccaccatcaggaaaggctcgtctgcgcgcgcaggctgttgcagaaaatccaccgcccgattgctgatacgatgcgcccaggtgaaggtttcgtcgatatggttcgcctgtaaatcttcgacgctgtttaggccattgcgccacaggctaatctctttttccgtcagttcgctaagatagttcgccccatcgaaccagtaatcagcgtcccactccggcggacactcgccagtgccgaaatagtcatgaccgtcgagatgccatttgccgatgtaacaggtgtgatagccggcatccttaaagtagcgccccatagtggagatgtttttgcctggcgcgacgttgttggtccacgggccggactggttagcgtagataccggtaaatagtccggcccgtgcaggcgtacaaaccggtgaacaggtgtaggcggaattaaagcgaataccttccgccgccagactatcaatattttgcgtattcagcggtttaccgctatagcaaccgaccatattggtggcctgggtatcggtcatgacgaacagaaaattggggcgtttcataggctatccttcccgtcgggagtaaaggttacggctgggtcgtgacgatgccgccagctgtcaaaaatcaggtagacaatcactacggcggcaatgaaataactgatcatcgctaaccagcgcgtaccgtagccgccgaattcagccagcccggcatagacgccaatcatcgcgaacaggatgccaattgacgcgatcttgacgtttttccacggtttcatgtccaccgcaaacgcatctttgaaggtgaacggcgtggcgcgcggtttgataaaaccgatcaccagcatcacgaccacgttgatgcagaacgtacaggccagcacatagaggaaatggaagtcgaacttcaccagatagttgatggtgatgtagctgattatgccaatccccatcgctacttttgccgccagcgccgggatgcgcgggaagaaaaagcccataatgatgatggtaaccagcggcacgttgtaaatgccgttgagctgtttcatccagctatacagcccctgcggcgcgttggcgatccacggcgcgaccagcaccgaaacgatagcgataaagaaaccaaatttgcgcccgacggtgaccagctgctgcggctcggcattctggttaatgatgcgacggtaaatacccatactgaataacgtactggcgctattcagaaagccgttgaaggtactgatcaccgcaccaaataacaccgcgccgaagaaacccaccattggcactggcagaacgttattgaccagcgtcgggtaggccatgtcggctttcggtaaatcctgatacagatgaaacgcaatcaaccctggcagcaccagtaccagcgggtcgagcattttcagcaccgccgttaacagcgcccccttttgcccttccgccaggctttttgacgccagcgtgcgttgcacgatgccctgatttgtacaccagtaaaaggtgttcaccagaatcaaaccggtaaatgccgcgccaatcggcaagggatcggtcgggccaccgattgagtttaatttctcggcgtgaacggtggtgagttgctcaatgccctgcataaagctgcccttgcccatcgcgattaggccaaataccggcaccatcaacccgccgataaccagcccaataccgttgatggagtccgccactgccattgcgcgcagtccgccgatcaccgcatacaaaattcccgccagaccaagcaaaattaccagtagccagatagccgcaccgtgagaaatctgtagcgattccccgacgtgaaacaggctgttgagcgccaacgcgccggagtagagaacaatcggcagaaagcagacgccggtggcaattaggaagcagaagtcgatgataatacgcgtcgttttatcataacgttcctccagaaaatcggggatggtggcaatgccgcgcttcagatagcgcggtaaaaagattagcgcgaggaagatcagcgtcaccgctgaagtcacttcccagcccatcaccgacatgccgcttttgtaggcctgcccggaaaggccgaccagttgttccgtggaaaggttggttagcattaacgaagcggcaataaccggcgcttttagtgaacgtccggcaagaaaatagccttgttgcgatccggtatctgttttgcggaccttccaccaggtgatcaccgccaccagcagcgtaaaaccgacaaaactcaagatttgtaacgaattcatctcatagcccttatttatgtttatgtcccggacgcatgaatatagggagaggtaaaatgcgtcgggtcaggcagtcagattcttaaaatacaaacgtcgtatccctgaacggattgttttctgttaagttcaggttgtgagcataattcgccggagggatattaaaatgaatggaaaattgcaaagttcagatgtaaaaaacgaaactccgtacaatattcccttattgattaacgaaaatgtgatctccagcggaatttctctgatctcgctctggcatacctacgccgacgagcattaccgggtgatctggccgcgggacaagaagaaaccgcttatcgccaactcatgggttgcggtgtataccgtacaaggatgtgggaaaattcttttaaagaatggcgaacaaataacactgcatggcaactgtattatattcttaaagccaatggatattcactcttatcactgtgaaggtttagtctgggaacagtactggatggaatttacccccaccagtatgatggatattcccgttggtcagcaaagcgttatttataatggcgaaatttataatcaggaactcaccgaagttgctgagttaataacttcaccagaagcaataaaaaataatctggcagtcgcttttctgacgaaaattatttatcagtggatttgtcttatgtacgcagatggtaaaaaagatccacaacggcggcaaattgaaaaattaattgccactttacatgccagtctgcaacaacgctggagcgtagctgatatggctgccacgatcccctgtagcgaagcctggttgcgtcgtctgtttttacgctataccggcaagacgccgaaagaatattacctcgatgcgcgtctggatctggcgctatcgctattaaagcaacaaggaaactcggttggcgaagtcgctgatacgctcaacttcttcgactcctttcatttcagcaaagcctttaaacataaatttggttatgcgccgtcagccgtgctaaagaatacggaccagcacccaacggatgccagtccacacaattaacgtaactctggccagtacgctttgttggcctccagcaactcatccagaatagctttggcgaccgaggcgctcggtaccgttttcgacaacgtaatcgcctgccacaggtgctgatatgaacgctgttcccaggcgtccacgaccagtttttccaccgccacttgctgactcattaaccctttctgaaactgcgggatatcgccgaccaccagtggttcaggccgtagtagcgcacgcgcatctgtttgcgatcttgcagcccaacaatttgcgccatccggctttcaataccgattggcatgtcacagatgttgaggattttcgcattcgggcgcagacgacgcgtggcttctgcgacaatggctgccgggttggagtagttgagcatccaggcatttggtgaatatttttccatataatccaccagttccaggacgccgccaatggaacgcatgccgtacgctattccgccgggtccgcaagtttcctgaccaacaacgccgtggcgcagcgggattttttcatccagttcgcgcatcgggtatttgccgacgcggatgtgcgccatgacaaaatcaacgtcgctgaatgccacttcaggatcggtggtgtaactaaacgcaatgtccggcgctttttctttaaggatgactttacaggcttcggcaatcacttcctgccgcgcaccatcgttatcataaaatttcagtgcacgaagcgggaaacggtcctgattcgccaggagcatcaacacgatgcctggcgtaaaggtgcttccaccgcctgcgacaaccactgagaatttggtcattatactgcctccgtaatggcaacattttctgctgattgatgagaattaattaagctatcgagctgttcacgcagctgagatacatgcagaccaatgatcacctgaatggcatcgccactacggaagacgccgtgcgctcccagctttttaaagacttcgtcatccagcgtttgtgacatgtcatgcagtgcaatacgtaaacgcgtcgcgcaattgttaatgctggagatattgccgaccccgcccagggcttgcaggataccggcagcctgatccagctctttttttggctctgccgcggtggtttggcctcgcgaggctttgtattcggcttttgagtagagtttcacttccgcatcttcacgtcccggcgtgcacatgttgaactgcagaatcagtgtgcggaaaaccacgaagtacagcagggtaaagcacaacccaatggcgatttgggtcagcatcatatccgcgtggttgctgaacatcgggatccagttttgcggtaaaacctagtcaatcagacctccgcccatgttgcccaccacaccaaagagatacattacggtcgacattgaggccgccagcacggcgtgtaccgcaaacagcaacggtgaaatgaacaggaaggtaaattccagcggttcggtaattcccaccagcatggcggttaaggttgcgggaatcagcaagcccgccacttttacccgattttccggtgcggcagtgaagtacatcgctaaagaaatgcccacggcaccaaagatttttgagttaccgtgcagggcaaaaccgccttccgggaacaacgatttcagcggctcggcgctcaaactgaactcttgcagatgctgcgcccagtacatctgaatgccgccttcaacagctgccggaccaaagataaactgtccgtagatgaagtggtgtaaaccggttgggatcagaatacgttcgaggaaggtgtaaacccagaccccaagtgcacccgccgaacgcaggaacgcttgcagagattcaatccccatttgtacttttggccagccgagcaacgtcagccaggcacaggggatcatcaccaggaaggcgataatcaccacataagacgtcccctggaaaatgccgagaaaaaccggcagttttttatcgaacagacggttatgcagcgccgtcacaatgccggaaatgataattgcgccgataatgctggtatcgagggttttaatcccggccatcattgtcagaccgctacctgccaccgcgtcctgagtgaaatcgacgccgaagtagcttccccaggtcattcccatcgcgttgatgaaatagttccaggtcaggaaactcaccatcaccgccagacaagcacgcccctgcgcttgcttagcaaggccaatgggtaaaccgacagcaaaaatcagcggcatattacggaataccgtccaaccgccctcttcaataatgtgtacgatttgcgcgaataaactgttcggatcggtcagtgattccccgacaaacatcgggttttgcagcaagatggcaagacccaccacaatcccggcgaagggaaacagcagcactggcgtgaacatcgcgccgccaaagcgttgaatttgactgagcatttccacatcctcttttctcaattctgtaagtaggaagcctgattggttatgcggcaggcctggagcgaggataggaagatgcgatcggcagaacatgacgacccaatgggattcgtgatcgctttcatgcttttcgttgggcggtagagatctacgttttcgcgaaaaagtagacctctgtgagcacaggtacacagcatcgaacacatctttaaaaaaaagatgttttttcaatcgattaagcagaacttgtgtgcgcattacccgggcttgcaggcaaaaaagagatctagagatgatctacaaaagcattgcggagcggttaagaattcgacttaactccgcagatttcacgctaaacagccttcttcccggtgaaaaaaagctggcggaagagtttgcggtatcgcggatgaccatccgtaaagccattgacctgctggtagcgtgggggctggtggtccgccgccacggtagtggcacttacctggtgcgcaaagatgtactgcatcaaaccgccagtctgaccgggctggtggaggtgttaaaacggcagggaaaaacggtcaccagccaggtgctgatttttgaaatcatgcctgcgcctccggccattgccagccagttacggattcaaatcaacgagcagatctacttctcccgtcgcgttcgttttgtggaagggaaaccgctgatgctggaagacagctatatgccggtaaaactgttccgtaatctttcgctgcaacatctggaagggtcgaagtttgaatatattgaacaagagtgcgggattttgattggcggtaattatgaaagcctgacgccagtgctcgccgatagactgctggcgcggcaaatgaaggtagcggaacacacgccactgctgcggatcacctcgttgtcatatagcgagagcggggagtttttgaattattcagtgatgttcagaaatgccagcgaataccaggtggagtaccatttacggcgactccacccggaaaagagttaaccgatactccagaagagcaccgccagtaattggggggtgataatgcgcaggaacattaccaacggatagacagtggcgtaagagagcgccgccgcaccgctggttggatgaagattattagcaaacgccagcgccggaggatcggtcatggaacctgccagcatcccgcacatggtcaggtaattcattttggctaacatccgcgccagaatgccaacagtaatcagcggaacggcggtgatcagggcaccataaccaatccagcttagcccttcgccattgaccagggtattcacaaaatccccaccagatttcagaccaacgaccgagaggaacagcacgatccccagctcccgcagcgcgaggttggcgcttggcggcataaaccagtacagcttgccgatactgccgatacgcccgaggatcaacgccataatcagcggtccgcccgccagccccagtttcaacgcggccgggaatcctggcacaaagacgggaatagaacctaacaatacgcctagcccgatgccaataaacactggcagcatctgaacctgttgcagtttttgctgcgcattccccagcacattggcaacggcatcaattgcggacggacgccccaccagattgaggatatcgccgaactgcaggctgatatcgccactggcgaccagttcgaccccggcacggttcaggcgcgagataacaacgtcatagcgttctttaaagtgcaggtcgcgaatacgttttccgagcacgttttcattggtgaccaccacacgctcgacgcgcaaatcagtgcctttcgtggacagcgaagtatcgacctcctgaccaatcaccagttgcgcattatgtaaatccgctggctgacccaccagatgcagcaaatcgcccagttggataatggtatctggcgaaggaacttttagggtttcttcgcgtttcagacgcgagcagataattttgtcgccgttgagaatcggtacatctttaatggctaaatcatgcaggttagggttctcaacgcgaatattgatagtcttgatcagcgcgccgccattggtgcgtgaagactcgtgctgctgagcttctgtctcgacattgacgcggaaaataacccgcaacatccacatggtgaacaaaatcccgcaaatgccgaatggatacgccatcgcgtaactcatccccatctgatcgaccatttccattggtgtacccaggtcgcgcaaaatctgctgccctgcccccagcgctggcgtattggtaaccgcaccggagaaaatccccagcactaccggcagtggaatatcaaacagtttatgcaggatggcggtaaccagaccaccgatgatgacgatcagaacagcaaacaggttgaggcgtaatccggagacgcgcaatgaggcaaagaagcccggccctacctgaatcccgatagtataaacgaacaggatcaggccaaattcctgaataacatgcagcatatcgctacttaatgtcatccccgcctgagaaacaaaatggccgacgatgatcccaccaaacagcacgccgccaatacctaatcctatgccgcgaaatttgacgttgccgataaacaaaccgacgactgccaccaaagccagaatactgaccgttaatgctatatcactcatcgtccatttctcttgagataacattttaattgctacggattatggctgaatcggtgaagcagatttgccttatagcgcacattatcacgggaaagaacgtgccgaaatatcttaaacagtcgaaatttaacgcattgttgagtaagtaagacaaaaaaagccccaccagaatggcggggcaaagagaatagctagttagctatttaacgcgggacgttcgctgatagcgatacgctgcgctgcgatgggttcaggctcattacgaattaaatcaatatgcagtaaaccgtttacgaaggttgcgccagagacttccatattttcagccagcgtaaagctcaggctaaatggctgattcataagcccttgatgcagccattttttctcttcttttggctgctccggcgtgccttttacgctcaggcgcgtaccttccagttgaatctctaaatcttcctgacggaaacctgccagcgcaagggtaatgcggtagtggttatcgtcgcttttctcaatgttgtacggcgggaagctctggctttcaccggcgttttgcagtgcgttggccagtttgtcaaaaccgatccattgacgcatcagtggggataaatcgaagttacgcatagtcatttctccttctaagaagcgagtaagtacctgcaaatccgaagattcgcatatgctccctgacggcgagcatggagatgtcaggccgcgccaggcggccttagggaattagttgatttcgatacggcgcggttttttcgcttccggaatcacgcgttcgagatcgatatacagcaaaccatttaccaggttagcaccacgaacatgaatgttctcagctaactggaatttgcgttcaaagttgcgttcagcgatgccctggtacagataggtgcgctctttttgttcgtcggcgtgagcacctttcaccaccagcagattatcctgggcggtaatttccagttcgctctcagcaaaaccagccacagcgatagcaatgcggtaatggttttcgtctaccagttcaacgttatacggagggtagccgccattactctggctctggttgttttctaagtggttaaacaaacggtcaaatccaatagcagaacggtaaagcggggataaatcaaagttacgcataatcaatagctcctgaaatcagcgagaatgtaagaccttccacaatggacaggtcaggtagccagaacacccatcaggcgcgtcctcatcggctacgatgtaaaaatgggtctggaaatgaacttttcaagccttatcagcggacttttttttgcagtttatggtctattgcatagactgagggggcagcacgaaacgttaaagtgcgatagccgccacagtgcgacgtaatgatgatgttattttcagcaagggatcgctataactcatcaggccaacacccacgatcaacagatgaatttattatgataagaaatgtgttgttagcgttcatgatatgcagcggaatgacattactcggaggatgctccagcgtgatgtcccataccggagggaaagaaggaacgtatcccggcacccgcgccagcgcaaccatgattggcgacgatgaaaccaactggggcactaagtcgctggcgattctcgatatgccgtttaccgctgtgatggacacgcttttactgccgtgggatgtgttccgcaaagacagctcggtgcgctcgcgcgttgaaaaaagcgaagccaacgcgcaagccaccaatgcggttattccaccggccagaatgcctgataactgatttagcgatcagtttcggtgatccacagctggccgccttccatccacgccagccactgaccatccggcgagaagaccacggcgtccgcagaaggtgaattggcgtggtgttcggttaaatactcaacctcgccgctttgcgcatgggcacaagcaattcgattatccagcacaaagcccaaccattctcctgacggatgccagttaaatgcagactgaatatccgttttgttatgggttaactggcgcggctcgccgccctgtggcgagataagccacagttgcacaatgccgttatcatctcgcattaaaaacgcgatttgtgtaccctgcggattacagcgcacccagtggcgcgggacgttgactaaccccggataagcccgatggtgggtaaaggttaaacgtcgctgcacgacgccacgcggtggcgcgggcagggttgtttccgttccgcttaacggcgcatcacctgccgctttccagccagcttcatcttgcggtaactcaacgataaacagctccggcactttctcgccctttggcgaaagtgtgtcgccaataaatgccagcgcgtgatttcctacccatccttcttcataagcacgattgatttcatcactgccaggctgtggcgtgggcgtggttttgctcaccagcacgcaccagtggctaccgctgtattcacgcggatgctgcttttgtacgttgaccgggccaaacggcgcagcaacaccgacgtttcgcaaatccagcgccggatcgagttcatgcattacatggtcgttataggtaaagctcaccctttcaccgttcgggctaaagacatgcacatggctgccgccgcgcagcactcctggcgtatacggcgcggtaatatccatcgcatcaaggttactcatcttgccgccttcaacaatcactccgcgccgatgatggaagtcgtaatgccatgtttcatcaggattttccgggccgtggatgaaaacatatttctctgacttcggatgaacggtcaccacgccgacgtgtgcgccctgtgacgcgcgatagataacctcgacctcgccggtatggatattcacacgctcaatggtctcgccggtaaacgacgcgccagaaggacgcacgtcaaataccagccactggctgtcgggcgtccaggtattggtattggtgagcaggtgattacggggagcaaaggttatctgtttcatggcgcggtcctgatacaaaacgggtcccgccatcatacttcacaaggacttcactttcagacaatagtcttttgccatcgtgatgaatgtgagtgaaaagatggaacatttcgacgtggcgattattggcctcggcccggcaggatcggcgttggcacgaaagttagcaggcaaaatgcaggtgatcgcgctggataaaaagcaccagtgtggtactgaaggtttcagcaaaccctgcggcggtctgctggcaccggacgcgcagcgatcttttattcgcgatgggctgacgcttcctgtcgatgtgatcgctaatccgcagattttcagcgtcaaaaccgtcgacgtcgccgcatcgctcacgcgtaactaccagcgaagctatatcaatattaatcgccatgctttcgacttgtggatgaaatcgctgatccccgccagcgttgaggtttatcacgacagcctgtgccgaaaaatctggcgtgaggatgataaatggcatgtcatttttcgtgcagacggctgggagcaacatattaccgcccgctatctggtcggtgccgatggcgcaaactcgatggtgcggcgacatctctacccggatcatcaaatccgtaaatatgtcgctatccagcagtggttcgcggagaaacatccggtgccgttctactcctgcatctttgataattcgataactaactgttattcatggagtatcagcaaagacggttattttatctttggcggtgcctatccaatgaaagacggtcagacgcgtttcacgacgctgaaagagaaaatgagcgcctttcagttccagtttggtaagacggtgaaaagcgaaaaatgcacggtgctgtttccctcgcgctggcaggattttgtctgcggtaaggacaacgcctttctgattggtgaagcggcgggatttatcagcgccagctcgctggaggggattagctatgcgctggatagcacagacattctgcgttcggtgttactgaagcagccagagaagctcaataccgcttactggcgcgccacccgcaaactgcgtttaaaactcttcggcaagatagtaaaaagccgatgcctgaccgcaccggctttaagaaagtggattatgcgcagtggtgtggcacatattccacagttgaaggattagccaacgcgcttcacatcgcccaccagcaggatataagagagcgcgccaatcaacgcgacggcggagatataaaccagtgcaggtgcgaaaccgtaaccctgcgccaggtaccccaccaccagcggaacggtgatgccgcccagaccaccggcgaagttaaacacgccgccggttaaaccaatcaggcgcatcggtgccagagaagaaaccagcgaccaggtaatcgaagcaaaaccgttaccgaagaatgccagcgccatcaggcacataatcatcatcggatcgttagtgtagttagcgcccataatgcaggtggagatcagcaagccgcagataatcggcgttttacgcgcaaagcccagtgaaaagcccttacgtaccagcagatccgctacccagccagagagcaggacgccgacaaacgccgcgaggaatggcaccgtggtcataaagcctgctttcagcgccgtgattcctttttcctgggttaaatagttcgggaaccaggttaagaaaaaccacagtgtagaagccaccgcaaattgcccaagataaacgccgatcagtttacgatggaacaccagtttccagtctttggctgttaacggctgacgcgcctctttcttcaccggcgcatcaccatccaccagaccgccgccatcacgaatgtaatccagttcagctttgctgatacctttggtcaggcgcggcggctgataaaccttaaaccaaatcagcgaccagataatgccgataccaccagtgacaatgaacacccagtgccagctcaacatctcctgaatccagatcagcagcggcgtcagaaacgccagaccgacaaactgaccagacgtataaaaaccaacggcagaagcgcgttcatgttccgggaaccagctggtcaccatccggttattggtcgggaaagcaggcgcttcgaaaataccggttatcgcgcgcagaccaattaatgacattaagcccgtggcaaagccctggaataaagtcgccactgaccagccaaatatcgcaataaaataagtcacgcgagaacctacgcgatctaaaaaccaaccgccggggatctgacatagcgtataaagccaggcgaaggccgaaaatacatagcccatttccgctttggtaatgccgaactcttcctgaatatgggcggaagccacggccaggttggcgcggtcgacataacaaatgactaccgtaataaagatcatcaccagcgtcagataacgccgacgccccggctttgctgcattaacgggaatatccatagcgagctttctccagattttgggcatagcgaagccgctcaccatgccctgtaatttacagagggttatatttttgtattgctgttttagtgcccgatgaggggcttacgtggcaggaattaccactctgctacgctgttatcttcatgacgccagagcggattacgccagtccggggcatttttactgaactcaatcactttagcttcgtcgatttccacgcctaagcccggtttcgttaacggtttaaagaagccgccgaccatgctgaagtcttctttgtttttcacaaagtcgagtaactccgcgcctttgttgtaatgaattcccatactttgttcctgaagtacggcgttataggaaacaaagtcgatatgcaggcaagccgccagtgcaatcggtccgagcggacagtgcggcgcaagggtcacgtcataggcttctgccattccggcgattttgtagcattcggtaataccgcccgcgtgggagagatccggttgcagaatcgaaataccacctgcctccagcacgcgtttaaaatcgaagcgtgagaacatgcgttcacccgccgccagtggaatatgcgtttgtgccgccagtttcgggtagtattcggcttgttccgccagcaccggctcctcaataaacagcgggcgatacggctccagttctttaatcagcactttcgccatcggcgcgctgacgcgaccgtggaaatcaagaccaaactcaatctgattgccaaaagcttcacgaatttgtgccacggtgttaaccgccgcatctaccgcgcgggagttatcaattagccccagttcttcacaaccgttcagtttgaaggtatcgaagccgatttcgcgtagcgttttaatgccgtcgataacatccgccggacgatcgccgccaacccaactgtaggctttaattttgtcgcgaaccaggccgcccatcagttgccagaccggcgcattcagcactttacctttgatatcccataacgcctggtcaatcccggcgatggcgctcatcaggatcggaccgccgcgatagaatccggcgcgatacatcacttgccataagtcattgatgcgcgatggatcctgaccaatcaaatagtcacccagctcgtgaactgccgcttccaccgtacgggcgcggccttcgatcacgggctcgccccaaccgaccacgccttcatcggtttcaattttcaggaacatccagcggggaggtaaacgatacgtggtaattttggtgattttcattgcactgcctctcgatacgccttaacaaatgctgctgcctgctgcgcggtgcgctctacggattgcccggcgcgatagagatcgctgcctaagcccgcccctgcacaacctgcgtctatccactgcgccaggttttctggcgtcacgccgccaacggcaaagactgcgatgtccgatggcaataccgcttttaacgctttgatgtattgcggaccaaaagccgatgacggaaatattttcagcgcctgcgcgcccgcttcgagcgcggtaaaggcttcggtcgccgtcgcgcagccggggcagacggtcatgccgtagcccaccgcacggcggatcacttcactatggatattgggcgtaacgatgagctgacagcccatcctggcgagcgcatcgacctgttcaggtttcagtaccgtacctgcgccaatcaacgccttgtcgccgtacgcatcaacgatggcgggaatgctttgctcccattgtggggaattcagcgggatttcaaccgcgtcgaacccggcgtcaatcaccgcgccaacatgcgccagcgcctcgtcgggcgtaataccgcgcaaaatggcgatcagcgggagtttagtttgccactgcatgagcgatgctccttataccagcctgaaatgccgtgtcgcccgccaccgccgtcacgtcgcaacccatcgcctgaaaggcttgctggtagcgcgcggtcagcgatgttccggcgacaagggtgatggcgtgttgatgggccacatagtcgcgcatactggcgacctctgcgccaatcaacaaaccagagagaaattcgctgacctgttcgcggggaagtgttcccagcacatgcgaggcgcgaacttcaaaaagctgcggcaatatggcgggcgtattaagaccacgctcaaggccagctgtgaaggcatcggcagagttttcctgcggcggcaaacctgcgccaatcaatgagtgatttaacagtaaatgatgtaattcaccggtcatcacggtgcgaaaatcgttgatttgctggctatcggcctgcacccatttgcaatgggttccgggcatgacataaagagaggaaggagccagagctcgcgcgccgatcaattgtgtttcttcgccgcgcatcacattgtggttatcgtcatgagagacacataatccgggaataatccagatattgtcgccaactgacgttaattgttcgccaatagacgaaaaacaggcaggaacagataaatacggtgcaactttccagccgacgttgctgccaaccattcctgccattaccactggcgttttctcttcacgccagtcggtcgtgacttctgctaacaccgcagccggagattttccgttcaggcgcgtgacgcctgcttctgattgcctgctctccaggcagtggtcgccctgataaagccaggcgcgcagattggtcgatccccagtcaattgcgatgtagcgagctgtcatgtgatttcctttaaccttcgtgtcgagctggcgatcatggtaagcgccgcctgctctgccgcatcgccgtcctgatgtcgtatcgcatcgaacagcgccttatgttcctggagcgtttgcggcatgttggcctcatcgcccatccaggttcgttcaaaaaccgcccgctgcagcgaactgatcgcaatgctaagttgctgtaacaccgggttatgcaccgactgcagcaccgcctcgtggtagcgaatatccgcttcgttaaacgcttcgcggtcctgattgttggcaatcatctcgttcagcgccgattcaatctgcgccagatcgctggaagtcgcgcgctctgctgcccaacgggcaatcgccggttccaccagatttcgcacttcgctcatggcactgataagccgtgggtcgtagtcattttccagcacccattgcagtacgtcagtgtcgaggtaattccactggttacgcggtgccacaaacgccccgcgataacgtttcatttcaatcagccgcttcgccatcagcgaacggaacacctcacggatgatgttgcgcgaggttgcaaactcctcacagagttccgcctcagccggaagcggcgagcctggcacgtatttgccgtgaacgatctgtttacccagcgtaatgacaatgcgatcggttttattgagagtcatggagagtccttgtgctctgtatgttcttctctactttaccccgatcgatgcataacgcggcaactttgtagtaccagcgtgatgacgttcgcgtttgccgtgcgtgtaatgtagtacaaacttatattgttgtactacaatttagatcacaaaaagaacaatgcataaaaaaatgacatgcgtcgggcagaaatctgaaaagggatatcaggcgctaaacaggagggaaagaagagtatgctttcaacggcttagctactcgtttaaaggattaatcatgaagttgaattttaagggattttttaaggctgccggtttattcccactggcgctgatgctttcaggctgtatctcgtatgctctggtttcccataccgcaaagggtagttcaggaaagtatcaatcgcagtcagacaccatcactgggctatcgcaggcaaaagatagtaatggaacaaaaggctatgtttttgtaggggaatcgctggattaccttatcactgatggtgccgatgacatcgttaagatgctcaatgatccagcacttaaccggcacaatattcaggttgccgatgacgcaagatttgttttaaatgcggggaaaaagaaatttaccggcacaatatcgctttactactactggaataacgaagaagaaaaggcactggcaacgcattatggttttgcctgtggtgttcaacactgtaccaggtcactggaaaacctaaaaggcacaatccatgagaaaaataaaaacatggattactcaaaggtgatggcgttctaccatccatttaaagtgcgattttatgaatactattcacccagaggcattccggatggtgtttccgcagcattactgccagtgactgttacgctggacatcattactgcaccgctgcaatttctggttgtatatgcagtaaaccaataatcagtaagcgggcaaacgcgtttatgctgtttgcccgcccacagattaattcagcacatacttctcaatagcaaacgccacgccatcttcaaggttagatttggtgacaaagttcgccacttctttcactgaaggaatagcgttatccatcgccacaccgacgcctgcatattcaatcattgcgatatcgttttcctgatcgccaatcgccatgatttcttccggtttaatacctaacacgtcggccagtgatttcacccccgtacctttgttaacgcgtttatcgaggatttcgaggaagtacggcgcacttttcagcacggtatatttctctttcacttcctgcggaatacgcgcgatagcctggtcgaggatggcgggttcatcaatcatcatcactttcaggaactgggtattggggtccattttctccgcttcgcagaacaccagcggaatggtggcaacgaaggattcatgcaccgtgtagtagctgatatcacggttggcggtgtacagcgtggtgcggtccagggcgtggaaatgagaaccgacttcgcgagagagtttttccaggaaacgatagtcgtcatagctgagagcagtttgcgccacggtgctaccatcagcggccttctgtaccagcgcgccgttataagtaatgcagtagtcgcccggctgttccatatgcagctctttcaggtagttgtgcacacctgcatacgggcgacccgtcgttagcacgacattcacgccacgggcgcgagctgcggcaatcgcatttttaacggcgggtgaaatggtgtgatcgggcagcagaagggtgccatccatatcgatagcaatgagtttaatagccatgagttccccaggtagattggttcctgacccatgctaacgcgattccgctcaaaaatcagtacaacacccgagggaaaagggggatgcaacgcgcgttgcgtgctccctttttgcttagcggaagagtttccctttcagcagttccatgcctgcggaaagcagatcgttattggcttgtggtgacacttcaccttgcggtgagagcgcatcaataatcttcggcaattgttctgccagtaaactggaagctgtactggtatccacgccaagtttttgcccgagatcggacaccgcatttgtgccgagcgccgattccagttgctcgccactaaccgattgattgccctgttgattactcagccaggttgagagaatggcccctaagccgccactttgcagtttttccagcagcacctgaatgccgccctgctcctcaacccaacttaaaatagcctgatatttccccgcatcgcctttcagaaaggcaccgacaacttcatcaaaaagccccatgataatcacctgtaaagcgttacgtgttgacccaaaaagtatagatttgcgggatgataattgcggattgcagaaataaaaagggcggagatgatctccgcccttttcttatagcttcttgccggatgcggcgtgaacgccttatccggcctacaaaatcatgaaaattcaatacattgcaagattttcgtaggcctgataagcgtagcgcatcaggcacgctcgcatggttagcgccattaaatatcgatattcgccgctttcagggcgttctcttcaataaacgcacggcgcggttcaacggcgtcgcccatcagcgtggtgaacaactggtcggcagcaatcgcatctttaacggtaacgcgcagcatacgacgactttccgggtccatagtggtttcccacagctgttccgggttcatctcgcccagacctttataacgctggatggagaggccgcgacgggactctttcaccagccagtccagcgcctgctcgaagctggctaccggctgacgacgctcgccacgttcgataaacgcatcttcttccagcaagccacgcagtttctcacccagcgtgcagatacgacgatattcgccaccggtgataaactcgtgatccagcggatagtcagtatccacaccgtgggtacgcacgcgaacaatcggctcgaacaggttttgctcagcattggtgtgaacatcaaacttccactggctgccgtgctgttctttgtcgttcagttcgctgaccagcgcgttcacccagcgggtaacggtctgctcatcagaaaggtcagcttccgtcaacgtcggctgatagataagctctttcagcattgctttcggataacgacgctccatacgattgatcattttctgcgtcgcgttgtactcagataccagtttctctaacgcttcgccagccaatgccggtgcactggcgttggtgtgcagcgttgcgccgtccagcgcgatagagatctggtactgatccatcgcttcgtcgtctttaatgtactgttcctgcttgcctttcttcactttgtacagcggcggctgagcgatgtagacgtgaccgcgttcaacgatttccggcatctgacgatagaagaaggtcaacagcagcgtacgaatgtgcgagccgtcgacgtccgcatcggtcatgatgatgatgctgtgataacgcagtttgtccgggttgtactcgtcacgaccgataccacagccaagcgcggtgataagcgtcgccacttcctgagaagagagcatcttatcgaagcgcgctttctcgacgttgaggattttacccttcagcggcagaatcgcctggttcttgcggttacgcccctgcttcgcagagccgcccgcggagtccccttccaccaggtacagttcggaaagcgccggatcgcgttcctggcagtctgccagtttgcccggcaggcccgctaagtcgagcgcacctttacggcgggtcatttcacgcgcgcgacgcgccgcttcacgggcacgggcagcatcgataattttgccaaccacgattttcgcgtcggttgggttttccagcaggtattctgccagcagttcgttcatctgctgttcaaccgccgatttcacctcagaagaaaccagtttgtctttggtctgggaggagaatttcgggtccggcactttcacggaaacgaccgcaatcaggccttcacgcgcatcgtcaccggtggcgctgactttggcttttttgctgtagccttctttgtccatgtaggcgttcagggtacgggtcatcgccgcacggaagcctgccaggtgagtaccgccgtcacgctgcggaatgttgttggtaaagcagtagatgttttcctggaagccatcgttccactgcaacgccacttcgacgccaataccgtctttttcagtggagaagtagaagatattcgggtggatcggcgttttgttcttgttcagatattcaacgaacgccttgatgccgccttcatagtggaagtggtcttctttgccgtcgcgcttgtcgcgcagacgaatggaaacgccggagttgaggaacgacaactcacgcagacgtttcgccagaatttcatattcgaactcggtcacattggtgaaggtttcgaggctgggccagaaacgcaccatggtgccggttttttcagtctcgccggtaaccgccagcggggcctgcggtacaccgtgttcgtagatctgacggtgaattttaccctcgcgctggataaccagctccagtttttgcgacagggcgtttactaccgaaacaccaacgccgtgcagaccgccggacactttataggagttatcgtcaaatttaccgcctgcgtgcagaacggtcatgatcacttccgccgccgatacgccctcttccgggtgaataccggtcggaatgccgcgcccgtcatcctgtacagagacagagttatcggcgtgaatggtgacgataatttctttacagtgacccgcgagcgcttcgtcgatagcgttatctaccacctcgaataccatgtggtgcagaccggtgccgtcatccgtgtcgccgatatacatacccgggcgcttacgcaccgcatccagccctttcaggactttgatactggaggagtcataagaattcgacatcaacgtttctcgctcatttatacttgggttaatccgttattttacccttttccacggtaaacatcttcgaattttcgtccgacatgtctataacgtgttcagcactgatcgcgctgacaaagacctgtgattgcgtcgcttttaagcggctggcaagcagcccgcgacgctcatcatcaagctcagaggcaaaatcatctatcaggtagagacaccgccgcccgctttcacgggtgaggaactctccttgcgccagacgtaaggcgcacatcaacagcttaagctgcccacgcgataaggtatcttccaccggcgcaccgtcggcgcgaatgcgtaagtccgctttgtgcgggccgtgcgcggtgtaggttagctggcgatcgcgttcaaaattacgttccagcacctcagcatattctgtctctttctcccagccgcgctggaaagagaaagtcagagaaaactcagggagaaattgcttacaggtatcagccatatcggccgcgataccggcgctatactccgcgcgccaggtgctgatttgctccgccagcgggatcagctctttatcccacgggcgtagctgttcgtaacgtgtcacctggcgcagcgccgcattgcgctgcttgagcaatcgcttgagattgctccaggcggtgaaaaatccgggttcgttgtgaaagcatccccagtcgaggaatgctcttctgtatttggggccgccgttgagtaaagtaaacccttctggcgttatcaactgcattggcatcaggtgcgccagttccgcgaccttatgcccgtctgtaccgtcgatgcggactttgctgtcgccctgtttgtctttggttaagccaatcgctgtctcgcgctcttcgccctgtaatcgcccgtggagaacaaacgcctcctgctcatggcgaatgacgcgaccaatctgcaaactgcgaaacgcccgaccatggccgagcgtatagatggcttccagcacgctggttttgccactgccgttggcacctaccagaaagttaaagccgggagataaggcgagatccgcggtttcaatgttgcggaaatcgcggatcaacaagcgggtgagggacattacagtctcattggcatgacaacataagccgcgctctggctggccgcatcttcaatctgcacgctggaaaccgaatcggtcagcatcatgcggacgttttcgcatttcagcgcgttcagaacatccagcacataactgacgttgaagccgatttccatctccgcaccgctataggtaacgtcgaggatctcttccgcttcttcctgttccgggttgttggcggtgattttcagctggttttcgctgacataaagacgtacgccgcggaatttctcgttagagagaatcgccgcgcgagcaaacgcctgcttgagcagatcgcagccagcttccagatgtttgtccgggttcttcggcagaacgcggcgataatccgggaagcgaccatccaccagtttggaggtgaagataaagtcgccaacgtgggcgcgaatgttgttgctgccaatctgtacgcgcagcggattgtcgccgccgtcgagcatacgcatcagttcaatcacgcctttacgcggtacgatcaccgaatggcttggcaaagattgaccaattggcattgaacagaccgccagacggtggccgtcggttgccacggtgcgcagttcttcaccttcggtttcaaacagcataccatttaagtaatagcgaacgtcctgatgcgccatagaaaactgggtcgcttcaatcagacgcttcatcgttgcctgcggcagggtaaattcgacttcactctgccagtcatcgaggttcgggaaatccgccgctggcagggtagacagcgaaaaacggctacgcccggagcgtaccagcatccgttcaccttccagctgcacggcaatttccgcgccttcaggcagaccacggcagatatcaaagaatttgcgcgccggaacggtcgtcgctcctggctcgtgtggctgaaccagcgcaacacgtgccaccatttccatctcgagatcagtaccggtcagcgacaacgtaccgtcagcaacctgtaacagcagattaccgagaatcggtagcgtaggacgaccacctaacggaccgctcacctgttgtagcggttttaataaatgctcacgttctacggtaaatttcataggtttacgatgacaatgttctgattaaatttgaaaaatcttctttgatatcgtggctctcttcacgcaactgctcgatcttacggcaggcatgaagcaccgtcgtgtggtcacggccaccaaacgcatcgccaatctccggcagactgtggttagtcagctctttcgccagcgccatcgccatctggcgcggacgcgccaccgagcgggatcgacgcttggaaaggagatccgcgactttgatcttgtagtactccgccaccgtcttctgaatattgtcgatggtgaccagtttttcctgcaatgccagcaagtcgcgcagcgcctcacgcacgaagtcgatggtgatcgcccgtccggtaaagttggcattggcaatgacgcggttcagcgccccttccagctcacgtacgttagatcgtagacgcttggcgataaagaacgccacttcgcccggcaaacgaatgtcgttttcgtcggcctttttcatcaggatcgccacacgggtttccagctctggcggttcgatcgccacagtcagtccccaaccgaagcgggatttcaaacgatcctcaacgccgttgatctctttcggatagcgatccgaggtgagaatgatctgttgattaccttccagcagggcgttgaaggtgtggaaaaactcttcctgagatcgttctttattagcaaaaaactgaatatcgtcgatcagcagtgcatctacggaacggtagtagcgtttaaactcttcgatcgcgttgttttgcagggctttaaccatgtcctgaacaaagcgctcggagtgcatataaaccactttggcattcggcttgcgcgccataatgccgttacccaccgcatgcagcaggtgagttttacccagacccgtgccgccataaaggaacaacgggttataggcaccgccagggttatccgccacctggcgagccgccgcgcgcgccagttggttagatttaccttcaacgaagttatcaaacgtgtgtttgacgtttacgttagaacgataggtcggttctgccggggccgggacgttatcccaacctgagcgcgtagaaggcgcagcacgttgcggctgcgtttgcgccacctgtgcaggggccgcgacgttgctcgtcactgccgcttgtggcgtttgcgtcaccggtttggtgccgacttcaaaacgcagctgtggggcatccgctccgcagaaactggttagcagtccattgatattattaaggtacttgtcccgtacccaatcgaggacaaaacggtttggcgcgtacagggccagcgtgttatcgctcagttccgcctgcaatgggcgtatccacatactgaattctgtggctggtaactcatcctgcaatcgggcaagacactgctgccaaagcgaaagtgacacggcggactccactcgaacaaaagtcgataatgactaaggctgaaacattcatgattgttgacgtacgtcgaaaagaccctgcttgagggtgacgcacgaaccgctgtctgcggttatatgcccgatcaagatcctgcaaaacgatcgggaccgcggatcatagcctaaactgcgcaagagatcttctgtttctcacagattttcccgatttatccacaggactttccagaactcgctaagtgtaaacgatcctgccgcgaggcgggcacgatttacgccgcatattggaaaatttaatgaccatagacaaaaattggcttaatcgatctaataaagatccaggacgatccttgcgctttacccatcagcccgtataatcctccacccggcgcgccatgctggtttccactggtgtgaggtcgtacattttccctgcgaaaaggtgcggaaaagcgcggtaaataaggaaagagaattgactccggagtgtacaattattacaatccggcctctttaatcacccatggcttcggtgtccatcgtttcatttttcggcggatatccaataaagccattgaatttattcaagtttaggtagaaatcgccatgaaacgcacttttcaaccgtctgtactgaagcgcaaccgttctcacggcttccgtgctcgtatggctactaaaaatggtcgtcaggttctggcacgtcgtcgtgctaaaggccgcgctcgtctgaccgtttctaagtaataaagctaacccctgagtggttaagctcgcatttcccagggagttacgcttgttaactcccagtcaattcacattcgtcttccagcagccacaacgggctggcacgccgcaaattaccattctcggccgcctgaattcgctggggcatccccgtatcggtcttacagtcgccaagaaaaacgttcgacgcgcccatgaacgcaatcggattaaacgtctgacgcgtgaaagcttccgtctgcgccaacatgaactcccggctatggatttcgtggtggtggcgaaaaaaggggttgccgacctcgataaccgtgctctctcggaagcgttggaaaaattatggcgccgccactgtcgcctggctcgcgggtcctgatagccctcattcgggtctatcaacgcctgattagtccgctactcgggccgcattgtcgtttcactccaacctgttcaagctacggaattgaggcattgcgcaggtttggagtgataaaaggcagttggttgacggtgaaacgcgtattaaaatgccaccctttacaccctggtggtgacgatcccgtcccgcccggaccatttgataccagagaacactaacgatggattcgcaacgcaatcttttagtcatcgctttgctgttcgtgtctttcatgatctggcaagcctgggagcaggataaaaacccgcaacctcaggcccaacagaccacgcagacaacgaccaccgcagcgggtagcgccgccgaccagggcgtaccggccagtggccaggggaaactgatctcggttaagaccgacgtgcttgatctgaccatcaacacccgtggtggtgatgttgagcaagctctgctgcctgcttacccgaaagagctgaactctacccagccgttccagctgttggaaacttcaccgcagtttatttatcaggcacagagcggtctgaccggtcgtgatggcccggataacccggctaacggcccgcgtccgctgtataacgttgaaaaagacgcttatgtgctggctgaaggtcaaaacgaactgcaggtgccgatgacgtataccgacgcggcaggcaacacgtttaccaaaacgtttgtcctgaaacgtggtgattacgctgtcaacgtcaactacaacgtgcagaacgctggcgagaaaccgctggaaatctcctcgtttggtcagttgaagcaatccatcactctgccaccgcatctcgataccggaagcagcaacttcgcactgcacaccttccgtggcgcggcgtactccacgcctgacgagaagtatgagaaatacaagttcgataccattgccgataacgaaaacctgaacatctcttcgaaaggtggttgggtggcgatgctgcaacagtatttcgcgacggcgtggatcccgcataacgacggtaccaacaacttctataccgctaatctgggtaacggcatcgccgctatcggctataaatctcagccggtactggttcagcctggtcagactggcgcgatgaacagcaccctgtgggttggcccggaaatccaggacaaaatggcagctgttgctccgcacctggatctgaccgttgattacggttggttgtggttcatctctcagccgctgttcaaactgctgaaatggatccatagctttgtgggtaactggggcttctccattatcatcatcacctttatcgttcgtggcatcatgtacccgctgaccaaagcgcagtacacctccatggcgaagatgcgtatgttgcagccgaagattcaggcaatgcgtgagcgtctgggcgatgacaaacagcgtatcagccaggaaatgatggcgctgtacaaagctgagaaggttaacccgctgggcggctgcttcccgctgctgatccagatgccaatcttcctggcgttgtactacatgctgatgggttccgttgaactgcgtcaggcaccgtttgcactgtggatccacgacctgtcggcacaggacccgtactacatcctgccgatcctgatgggcgtaacgatgttcttcattcagaagatgtcgccgaccacagtgaccgacccgatgcagcagaagatcatgacctttatgccggtcatcttcaccgtgttcttcctgtggttcccgtcaggtctggtgctgtactatatcgtcagcaacctggtaaccattattcagcagcagctgatttaccgtggtctggaaaaacgtggcctgcatagccgcgagaagaaaaaatcctgattcggtgagttttcgctaaaataagggcggtcagttgaccgccttttttcttttcgtagggcggataagcaccgcgcatccgccacacaaagcaacaggaacatcatgagcgataatgacactatcgtagcccaggccacgcctccgggacgtggcggcgttggcatcctgcgcatctccggcttcaaagcccgtgaagttgccgaaaccgtgctgggtaaactgcctaagccgcgctacgccgattatcttccgtttaaagacgccgacggcagcgtgctcgatcaggggattgcgctatggttccctggcccgaactcgttcaccggcgaagatgtgctggaactgcaaggtcatggcggtccggtgatcctcgacctgctgttaaaacgcattctgaccattcccggcctgcggattgctcgccctggtgagttttccgaacgcgcgtttcttaacgataaacttgacttagcccaggccgaggcgattgccgatcttatcgacgccagttcggaacaggcggcccgttcggcacttaactcgctgcaaggcgcattctccgcacgggttaatcatctggtagaagccctcacccacttgcgcatttacgtcgaagcggcaattgatttccccgatgaagagatcgatttcctctccgacggaaaaattgaagcccagctcaatgacgttattgccgatcttgatgcagtgcgtgctgaagcacgtcagggtagtttgttgcgcgaagggatgaaagtggtgattgccggacgtcctaacgccggtaaatcgagcctgttaaacgcgctggcggggcgtgaagcggcaatcgtaaccgatatcgccggaactacgcgtgacgtgctgcgtgagcatatccacattgacggaatgccgctgcatatcatcgataccgccgggctacgtgaagccagtgacgaagtagaacgtattggtatcgagcgcgcgtggcaggaaattgaacaggccgaccgcgtgctgtttatggtcgatggcaccacaacagacgccgtggatccggcagagatctggccggaatttattgcccgtctgccagcgaaactgccgatcaccgtggtgcgcaataaagccgatatcaccggcgaaacgctgggaatgagtgaagtgaacggtcacgcgttaattcgtctctcggcaaggactggtgaaggcgtggacgtgctgcgtaaccatctcaaacagagcatgggctttgacaccaacatggaaggcggcttcctggcgcgtcgtcgccacctacaggcgctggaacaggcagcggaacatctacaacagggcaaagcgcaactgttgggagcctgggcaggtgaactgctggcggaagagttgcgtctggcacagcagaacttaagcgaaatcaccggggaatttacttcagacgacctgctggggcggattttctccagcttctgtattggtaagtaaccgcgcttacgaagccgcattctgactgtcagatgcggcttcgcttcattgttaccactcctgttattcctcaaccctttttttaaacattaaaattcttacgtaatttataatctttaaaaaaagcatttaatattgctccccgaacgattgtgattcgattcacatttaaacaatttcagaatagacaaaaactctgagtgtaataatgtagcctcgtgtcttgcgaggataagtgcattatgaatatcttacatatatgtgtgacctcaaaatggttcaatattgacaacaaaattgtcgatcaccgcccttgatttgcccttctgtagccatcaccagagccaaaccgattagattcaatgtgatctatttgtttgctatatcttaattttgccttttgcaaaggtcatctctcgtttatttacttgttttagtaaatgatggtgcttgcatatatatctggcgaattaatcggtatagcagatgtaatattcacagggatcactgtaattaaaataaatgaaggattatgtaatggaaaactttaaacatctccctgaaccgttccgcattcgtgttattgagccagtaaaacgtaccactcgcgcttatcgtgaagaggcaattattaaatccggtatgaacccgttcctgctggatagcgaagatgtttttatcgatttactgaccgacagcggcaccggggcggtgacgcagagcatgcaggctgcgatgatgcgcggcgacgaagcctacagcggcagtcgtagctactatgcgttagccgagtcagtgaaaaatatctttggttatcaatacaccattccgactcaccagggccgtggcgcagagcaaatctatattccggtactgattaaaaaacgcgagcaggaaaaaggcctggatcgcagcaaaatggtggcgttctctaactatttctttgataccacgcagggccatagccagatcaacggctgtaccgtgcgtaacgtctatatcaaagaagccttcgatacgggcgtgcgttacgactttaaaggcaactttgaccttgagggattagaacgcggtattgaagaagttggtccgaataacgtgccgtatatcgttgcaaccatcaccagtaactctgcaggtggtcagccggtttcactggcaaacttaaaagcgatgtacagcatcgcgaagaaatacgatattccggtggtaatggactccgcgcgctttgctgaaaacgcctatttcatcaagcagcgtgaagcagaatacaaagactggaccatcgagcagatcacccgcgaaacctacaaatatgccgatatgctggcgatgtccgccaagaaagatgcgatggtgccgatgggcggcctgctgtgcatgaaagacgacagcttctttgatgtgtacaccgagtgcagaaccctttgcgtggtgcaggaaggcttcccgacatatggcggcctggaaggcggcgcgatggagcgtctggcggtaggtctgtatgacggcatgaatctcgactggctggcttatcgtatcgcgcaggtacagtatctggtcgatggtctggaagagattggcgttgtctgccagcaggcgggcggtcacgcggcattcgttgatgccggtaaactgttgccgcatatcccggcagaccagttcccggcacaggcgctggcctgcgagctgtataaagtcgccggtatccgtgcggtagaaattggctctttcctgttaggccgcgatccgaaaaccggtaaacaactgccatgcccggctgaactgctgcgtttaaccattccgcgcgcaacatatactcaaacacatatggacttcattattgaagcctttaaacatgtgaaagagaacgcggcgaatattaaaggattaacctttacgtacgaaccgaaagtattgcgtcacttcaccgcaaaacttaaagaagtttaattaatactacagagtggctataaggatgttagccactctcttaccctacatcctcaataacaaaaatagccttcctctaaaggtggcatcatgactgatcaagctgaaaaaaagcactctgcattttggggtgttatggttatagcaggtacagtaattggtggaggtatgtttgctttacctgttgatcttgccggtgcctggtttttctggggtgcctttatccttatcattgcctggttttcaatgcttcattccgggttattgttattagaagcaaatttaaattatcccgtcggctccagttttaacaccatcaccaaagatttaatcggtaacacctggaacattatcagcggtattaccgttgccttcgttctctatatcctcacttatgcctatatctctgctaatggtgcgatcattagtgaaacgatatcaatgaatttgggttatcacgctaatccacgtattgtcgggatctgcacagccattttcgttgccagcgtattgtggttaagttcgttagccgccagtcgtattacctcattgttcctcgggctgaagattatctcctttgtgatcgtgtttggttcttttttcttccaggtcgattactccattctgcgcgacgccaccagctccactgcgggaacgtcttacttcccgtatatctttatggctttgccggtgtgtctggcgtcatttggtttccacggcaatattcccagcctgattatttgctatggaaaacgcaaagataagttaatcaaaagcgtggtatttggttcgctgctggcgctggtgatttatctcttctggctctattgcaccatggggaatattccgcgagaaagctttaaggcgattatctcctcaggcggcaacgttgattcgctggtgaaatcgttcctcggcaccaaacagcacggcattatcgagttttgcctgctggtgttctctaacttagctgttgccagttcgttctttggtgtcacgctggggttgttcgattatctggcggacctgtttaagattgataactcccacggcgggcgtttcaaaaccgtgctgttaaccttcctgccacctgcgttgttgtatctgatcttcccgaacggctttatttacgggatcggcggtgccgggctgtgcgccaccatctgggcggtcattattcccgcagtgcttgcaatcaaagctcgcaagaagtttcccaatcagatgttcacggtctggggcggcaatcttattccggcgattgtcattctctttggtataaccgtgattttgtgctggttcggcaacgtctttaacgtgttacctaaatttggctaaatccttcaagaagccagccattcgctggcttcttgcctctcaggaaatcacttatgtccaaatggcaactcgcctgatcctccttcaccacgtatgctttgcgtcaccttactatcaggacgctttagcccatgtcccgctttttgatttgtagttttgccctggttttactttatcccgccgggattgatatgtacctcgttggtttaccgcgcatcgccgccgatctcaatgccagcgaagcgcagttgcatattgcgttctccgtatatctggcggggatggcagctgcgatgttatttgccggtaaagtggccgatcgttcagggagaaagccggtcgccatacccggcgcggcgctatttattattgcctcggtgttctgttcactggctgaaaccagcacgttatttcttgcaggccgatttctacaggggttgggcgcaggctgttgttacgtagtggcgttcgctattttgcgcgacacgctggatgatcgacgtcgggctaaagtgctgtcattactcaacggtattacctgcatcattccggtgttagcgccagtgctcggacatctgattatgcttaaattcccgtggcagagtctgttctgggcgatggcaatgatgggcatcgcggtactgatgttgtctttgtttattttaaaagaaacgcgcccagcggcccccgcagcttcggataaaccacgagaaaatagcgagtcgctgcttaaccgttttttcctcagccgtgttgttatcaccaccctcagcgtttcggtgatcctcactttcgtcaacacgtcaccggtattgctgatggaaatcatggggtttgagcgcggtgaatacgccaccattatggcgctgaccgctggcgtcagcatgaccgtttcattctccacgccatttgcgctgggaatttttaagccacgtacgttgatgatcacctcgcaggtgttattcctggcggcggggatcactcttgccgtttcaccttcccatgcggtttctctgtttggtatcacgctgatttgcgccggtttctcggtaggttttggtgtggcgatgagtcaggcgttagggccgttttcattacgcgcgggcgtagccagctcgaccttaggtattgcgcaggtttgcggttcgtcactgtggatttggctggcagcggtggttggtatcggcgcatggaatatgctgatcgggattctgattgcctgtagcatagtgagcctgttgctgattatgttcgtcgcgcctggacgccccgttgccgctcatgaagaaatccatcaccacgcttgatctcaatctgctgctttgtctgcaactgctgatgcaggagcgcagcgtaaccaaagcggcgaagcggataaacgtgacaccttcggcggtgagtaagtcgctggcaaagttaagagcgtggtttgacgacccgctctttgtgaactcaccgctgggtctgtcgcccacaccgctgatggtcagcatggagcaaaatctggcggagtggatgcaaatgagcaacctgctgctggataaaccgcaccaccagacaccgcgcggcctgaagtttgagctggcggcggaatcaccgctgatgatgatcatgcttaatgcgctgtcgaaacagatctaccaacgttacccgcaggcgaccatcaaattacgtaactgggattacgattccttagatgccattactcgtggtgaagtggatatcggtttttccggtcgcgaaagccatcctcgctcgcgggagctgttaagctcgctaccgttagccattgattatgaagtgctgtttagtgatgtgccctgcgtctggttacgcaaagatcatccggcactgcatcaaacgtggaatctggacaccttcttacgttatccgcatatcagcatttgctgggaacagagcgatacctgggcgctggacaatgtgttacaggagctgggacgcgaacgcacgattgctatgagcctgccggaattcgagcagtcactgtttatggcagcgcaacccgacaatctgctactggcgaccgcgccgcgctactgtcagtactacaatcaactccatcaactgccgttggttgctcttcctctcccgtttgacgaaagccagcaaaaaaagctggaagttccttttaccctgctgtggcataaacggaacagccataatccgaagatcgtctggttacgggaaaccattaaaaacctttacgcgtcgatggcataaccgaatcgtatgaaacgcgacccaatttcacaataaaatgtaaaaaagttgtaataagcttgtctgaatcgaacttttagccgctttagtctgtccatcattccagtaaatgattactcttgtattcataatggaccattaagcatggagcgaaaaatggcgactcactttgcccgagggattttaacggaaggacatctgatttctgttcgtctcccctcccagtgtcatcaagaagcccgaaacattccccctcatcgtcaaagccgttttctggcgtccagaggtttactcgcagaactgatgttcatgctgtatggcattggcgaattgccggaaatcgtcaccctgccgaaaggtaaaccggttttcagtgataaaaatttgccttcgttttccatttcctatgccgggaatatggttggcgtggcgttaacaaccgaaggtgaatgtggcctcgatatggaactacagcgtgcgacgcgcgggtttcatagcccacacgcgcccgataaccacaccttttccagcaatgaatcgctatggatcagtaaacaaaacgatcctaacgaagcgcgggcgcagctcatcacgctgcgccgaagcgtgctaaaactaaccggtgatgttttgaatgacgatccgcgcgatctgcagctgctgcccattgccggacgcctgaaatgtgctcatgtaaatcatgtagaagcgttatgcgacgcggaagacgtgctggtgtggtccgtggcggtcacgcccacgattgaaaagctcagtgtctgggagttagatggcaaacacggctggaaaagcctgccggatattcacagccgcgccaacaatcctaccagccggatgatgcgttttgcccaactctctaccgtgaaggctttttcgccaaattgatagacaaccacaggagtcatcatgtctgaaaaattgcaggtggttacgttactggggagcctgcgcaaaggctcatttaatggcatggttgcacgtaccctgccgaaaattgctccggcgagcatggaagtcaatgcgttaccatccattgccgacattcccttgtatgacgctgacgtacagcaggaagaaggttttccagcaacggttgaagctctggcggaacagatccgtcaggctgacggtgtggtgatcgtcacgccggaatataactactcggtaccgggtgggctgaaaaatgccatcgactggctttcccgcctgccggatcaaccgctggccggtaaaccggtattgattcagaccagctcaatgggcgtgattggcggcgcgcgctgtcagtatcacctgcgccagattctggttttcctcgatgcaatggtgatgaacaagccggaatttatgggcggcgtgattcagaacaaagttgatccgcaaaccggagaagtgattgatcagggtacgctggaccacctgaccgggcaattgaccgcatttggtgagtttattcagcgagttaagatctaaataaaaaacccgccagcaatcatgcatggcgggtttttaacgcgctatcgattttagtgagcgtcgataaagacaatcttcaggataaacagcagcgcaacgatgattacgcacgggcttagatcacgcagacgtccggtaccgattttcatcacgcagtaggagataaagcccagcgcgataccttcggtaatcgagaagctgaacggcatcatcacggcggtaataaacgccggaacagattcagtaagatcctgccagttcacgcgtgccagactggaagtcatcagcacgccaacgtaaatcagcgcaccagctgcagcgtagcctggcaccatccccgccagcggcgacagaaagataaccagcaggaacagcagaccaacaaccactgccgtcagaccggtacgaccgccaaccgatacgccggaagaggactcaatataagccgtaacggaagaagtaccgataaacgaaccggtcacggaagagatactgtcgacatacagcgcctgcttcatgcgcgggaatttccccttctcatccgccagacctgctttatcggtcacgccaatcagcgtaccggaggagtcaaacaagttgaccaacatgaaagagaaaatcacccctgccagcccgaggttaaacgacccggctaaatctacatgacccacaactgtcattacgctcggcggcgcagaaacgatgccattgtagtgcacatcacccagcatccagcccagcagcgtcgtcaccacgatagaaaccagcaccgctgcgtgaatgttgcgcgaggccagaatagcaatgatgaagaagccgaggatacccagaagtacgctgtgagaagtcagattaccgatgctcaccagcgtttccgggttagcgacaatcacacctgcgtttttcagccccatcatgccaatgaacagaccgataccgctggtaatacccacacgcagactcaccggaatgttggctatcatccagtagcgaacgcggaaaatcgtcagtaacagcagacctatcgcgccccagaagattgcgcccatcccgacctgccacggcaagcccatcgcctgtacaacgacaaaagcgaagaacgcattcaggcccatagcgggtgccagtgcaactggcaggttagcaaacagtcccatcataatactgccgaatgcagcgatcagacaggtagtgacgaagacggcgctggtatccatgccagcaacgccaagaatttgcgggttaacaaaaacgatgtaaaccatcgtcaggaaggtggtaaaaccggcgatcacttcggtccgtgccgtcgtgccatgttcgcgcagtttaaacacgcgttccagcatcccctgaccagaagtctgggtggtatgttgatgactcattatctatttccgaacaaggagggaaaatccgtcgctatcgtataccaaaatgcgacaataggcgcgtttgtgagagacttttttattggatttacttatacggcaacgattgcgttgcgcaaatcggctctacgaaaacgttaaactgattaaaaaggaaaggcatgtcccggatagaagcggtatttttcgactgcgacggtacgctggtcgacagtgaagtcatttgctctcgcgcatatgtaacgatgtttcaggaatttggtattacgctcgatcctgaagaggtattcaaacgtttcaaaggtgtaaaactgtacgaaattatcgatattgtttcccttgaacatggtgttacgttagcgaaaacagaagctgaacacgtttaccgtgcagaagtcgctcggctgttcgattcagaactggaagccatcgaaggggctggagcgctcctgtcagcgatcactgcgccaatgtgtgtggtatctaacggcccaaataacaaaatgcagcattctatgggcaagctgaatatgttgcactacttcccggataaactgttcagcggctacgatattcagcgctggaagccagacccggcgttaatgttccatgcggcaaaagcgatgaatgtaaatgtagaaaactgcattctggttgatgactcagttgccggtgcacaatctggtatcgacgcaggtatggaagtgttctacttctgcgccgacccgcacaataagccgatcgttcacccgaaagtcaccacctttacccatctttcgcagttacctgaactgtggaaagcgcgtggttgggatattacggcatagttcttcacactcccttcacttaccccgcttaaattggcgctcaaaggtaagtaaagggagtttgatatgtctgtttcacgtcgggtaatacatcacggactttattttgcagttttaggaccgttaattggtgttctgtttcttgtcctctacatattcttcgcaaaagaaccgctggttctttgggtgataatacatccaatttttctcttattgtcgataactacgggagctattcctgcgttgttaaccggtgtaatggttgcctgtctgccggaaaagatcgggtcacagaaacgttatcgttgtctggctggtggcataggtggcgtcgttatcaccgagatctattgtgcagttattgtacatattaagggcatggcttcctcggagttgtttgaaaacattctttctggtgacagtctcgttgtccgcatcattcctgcattgctggcaggtgtggtgatgagcagaatcattacccgtctacccggattggatatttcatgtcctgaaacagactctttaagttaagcgggatactttatctttgggctactcaaaagcagacaggatgtttctatgactcaaaatatcaggccgttaccccaattcaaatatcatcccaagccactggaaacaggcgcatttgaacaggataaaaccgtagagtgcgattgctgtgaacaacagacgtcagtttattactcgggtcccttttattgcgttgatgaagttgaacatctctgtccgtggtgtattgcggacggttctgctgctgaaaagtttgcaggtagttttcaggatgatgccagcatagaaggtgttgaatttgagtatgatgaagaggacgaatttgccggtattaagaacacatatcctgatgaaatgctgaaagagttggttgaacgcacgccaggttatcatggatggcagcaggaattctggctcgcgcattgtggcgatttctgtgtttttatcggctatgtgggctggaatgatataaaagatcgcctcgatgaatttgccaaccttgaagaagattgtgagaatttcggtattagaaattctgatctagctaaatgcctgcaaaagggtggtcattgtcagggttatctcttccgctgtctccactgcggcaagctgagactgtggggtgatttttcgtagttatttaaataatgagaacaggccggagcgtaattcacacatccggccttatttcttaagcttaaccgagtgctaattctgcggcagcggctttatcagcgattaccatcagcgaaggatgcagctgcaacacggaagctggaacatcttcggtaaccggaccttgcagaacatttttcagtgcctgcgctttacccgcgccgctgacaattatcagcaagtttttcgccgccatgatgcttttcggccccatcgtcacgtagctgtcaggcactaacgaaaagtcgccgcccaactcgccatgcgccacaatatcaaccatctctccctggatcgggaactccacggtttgctcatggaaatgggtcgtattcggcaaattgccacaaaaatgaccatctgcacctaatcccagcaccaccaaatccagtccgccttcacgcgccagtttctgatcatgctcgcggtagttatcaatagtgagcttctggatattctcttctttgatccccgcaggggtgaaaaacagattacgcagattggtaatcgttacgccttctccctctttgccgcgaaatggaatttcatcaaaattatagaaatagcagttatcgtaccagggcttacctttaaccagggtggtgaggtattcatacatgcctttgggcgtgctaccggcggtaattgccaggttaacacgacgcgtcttcgacatataaccaagcagatggtgtgccgcgacacggctcatttcctggtaatcttcggtaatgattaatttcatcttaatgccttattttatttaaataatttctgtacaaaggctgcataggctggtcgccagacatccatttcatggttcagacccggatattcctggtaatcaaagttaatttttttctgctcaagctcagttttcagcccggcgatatccttgccggttacgacatctttatcccccacaaccacagtaaaattacgtagttgctggttgatagctgccggatcgttcagtcgggccgcgacaccttcatccggtacggttgtcgtggtaacaccactgaatgtggccagccagccaaagctttccagatgattcattccggaaaccagcgcctggtacccgccttgtgaaagccctgccagcgcgcggccatcggcatctttacggacattaaaacgcttgctaatcagcgggataatatcgttcatcagttcgcgatctgccgctttagcattcagcggataaaagactttacgtctttcctgaggcacgaaatcttcgggaataatgcccttcgcatcggtttctgtatccgggatcaccaccagcatcggtttaattttcccttcagcaagcaggttatccatgatttgcgggatacgcccctgatcgatagcggaacgtccggtatcaccaaagccgtgatagaaatagagcactggcaaaggctcgcccatgccggtgtatcctggcggggtccagacatacatctgacgttcagattgcaatgcgttggagtggtaagttatggcgatcaaatcaccatgcgcaacagaacgcgtatccagataactgcctggcaccagaatcatactggagttaacctggcgctgaggattagtcattgcggtgcctgtatcaatgctgcgtacaccatcaacattgaaaaaatactcgtacaggttgcctttcaggataggtgtgcgccacgaccagactcctgcttcgtctttggtcatcgggtgaatattgtccggaaccggaacacccaccactacagagacattttttgccccaggggcaaagtagcgaaaggtcacgctgttatcggcattgacctgagtcacatactgtttcaccgggatagtgggtgccgggctggctggcatatccgctgctatggcccactgagcagaaataccgctggcaatagccagcgttaaagcagcaatttttatattcatcgtaatattcctttcattaagttccattaccaccagatttcagcctgggcaccgacagcaaactggtcgtctttattgtcttcaaaggtgaagccatccagttcgttttccagggctttgatatacgtggcgtagaaacgaatttccggacgcgaggtcaacatactggtattgactttaaaggtatggaagagcgtggttttataaccagactcattaaatttattactattcgcatctttgttttgctgggtgaaatagcccagttcaacacctgtctggttatattggtcccaaatataggccgggcgaacaaccgcacgaatagattcgaaatcagagtgggcgcctgtttcgtagctatatatatcgttaccgaaggagtaaacaatcgcgttagctacaatgaaatgatcgccaatataggcttcgccctgcgaagtcagacgtaccgctgttccgccggtgtgatcaccataataacgaccattaaaggtggtaaatggacttgcgccagcataacggccaaagttactggcgatagagttattcgcgaccaggaaggagaattcgttgaagccacctttatcaaatttctgcgttaaagatgtgccaaacatccaggtatctttccagtcataatacccgttattatcctgattatctttttccgatgcgctttcgtttgccgtgacataacgaccacttaccattaaggtggctttatcccataacgggatatctttatagcgtaaatcaatggtattggtattaatctgctgtttgttttgcaggctgcgatcgtaatcatcgacatcttcgcgaaccagcgcgatatcaattttacccggaccgactttccagttttccagacctacacccgctgcggcatcagtacgctgcgttttccagtcaagcatctggatttcaattttcggcgcaccgtgtttacccacccagaaatcagcctctggcgcaaagggcaggaaacctttggtggtaacgtacatatcggagaactgcatatagttctcgccaccggcgttatcgccaaaccagccggtagagtactgctgaccaacgttaccatccatcatcacaacggcatcaacccgtttgccgttttcgttgtagacacgttgttttaactgcaaatcaaaccagccggagtattcgttaccaaagcggcccagagaaccaatcgcccatgatttaggtgaaccatgagaggcggtcccccaaccagaacggtaatagccgttgtaactaaagccaatttcatctttcacaaatttactgaaatctttcagagtcatggaagaataaatcgagcctgtctcactggcatttttctcttcatttttgaccagtacagcatcaggttttgcggcactactggtcgggaacggattggcggcatacccttgatcattcgtacttacgctacgattcaccgtcgctggcgtatactttttcttctcttcatctttatactttttgagttcgctttgcgtttctcttaacgccttttctaataactcaaggcgttgttccaccgttaatgattcagccaatgattgtgcagaaaaggctaacggtgccattaataagatggcagaggtaataagatttcgtctaaacataatatccctttatggtgcaaagaaagaattaacgcatcgcatccagactgttctgaatgcgacgataattaaggtgctttaatggttattttttttaatgacagcccccgcgtcttgatcacctctgcataccatccgaagcttttcttgcgtgttcttgtgaggcttccttcgccattatcatcacgatccacataaataaagccgtagcgcttagacatttgtgaatgagatgcactgactaaatcaattggcccccaactggtgtaccccataatatccacaccatcggcaatcgcttcatttacctgtaccaggtgatcgtttaaataggcaattcgataatcgtcctgtatcgaaccatccgcttcaacgctgtcttttgcgcctaatccgttctcgacaataaataacggtttttgataacgatcccaaagcgtatttaacagaacccgtaatccaaccggatcaatttgccacccccactctgaacttttcagatgcggattggggatcatattcagtatgttgccctgcgcatttttattaatgctttcgtcgtgggaaacacaaccagtcatgtaataactaaaagagatgaaatcgacggtatgttttaaatcttctgcgtcactttcagtcatctcaatggtgatattgtggtcgcggaagaaacgctgcatatagccgggatactggccacgcgcctgaacatcaccaaagaacatccagcgccggttctcttccatggcctgcaacatatcctgtggctggcaggtgagggggtaaaccagcccaccgagaagcatattgccgattttcgcttcggggagcaggctatgacaggctttaactgcccgcgcactggcaaccagttgatggtggatagcctgataaacttccgcctcgccactctcttctgccagccccacgcccgtgaatggcgcgtgtaacgacatgttgatttcattaaacgtcagccataacgccactttatgttggtagcgagtaaagaccgtgcgggcgtaatgctcgaagtgatcgatgaccgctcgattagcccaaccgccgtagtttttcaccagcccatatggcatttcgtaatgggataacgttaccagcggcttgatccccgcctgcgccatttcatcaaacagccgatcgtaaaacgctaaccccgcttcattcggttcgacttcgtcgccctgagggaaaattcgcgcccaggcaatggaaatacgcagacaggtgaagcccatctcggcaaataacgcgatatcttccgggtaacggtgataaaaatcgatggcgacatctttgatattctctttccccaggatgcgcggttccatttttcccattacgccatgaggctgtaaatctgaggtcgagatccctttgccatcttcctgccaggcaccttccacctgattggcagctgttgcgccaccccaaagaaatgtttctggaaatgctttcataattaactccttttatcgttagcgaatgatggataacagcggttcacctgcgcttatctgcgccgtgccgtggggtaatacgtccgtaaaatcatcgctattactgattaataccggcgtcgtcagatcaaatccggcctcgcgaatagcagggatatcaaaagaaatcagccgatcgcctgtattgaccttgtcacccacgttgacgtgagcggaaaagaatttgccgtccagttttacggtgtcgataccgacatgaatcaggatctccacaccatcatctgactcaatgccaatggcgtgtaatgtggcgaacaacgaagcaattcgacccgcaaccggagaacgcacttcaccaaccgagggcagaatggcaatacctttacccaacaggccactggcaaacgtggtatcagcgacgtgaatgagcggcacaatctctcccgtcatcggtgaacagataccgccctgctcaggtggtgtaataacctctggtgttttctcttgcggggcaccctgcgctggctgacgtttagcggtgatgaaatgaagcatcaccgtaccgacaaatgcgcaaccgatggcaatgacaccgccaataacgctggcccagacggtgaaatcaattcccgttgacgggatggtttgcatgaaggtgaaaatacttggcaaaccaaaggagtagactttcgtttgcgcgtagccaataatggtggcccccaaagccccactgatacaggcgataacaaaggggtacttacgcggcaggttgacgccatataccgctggttcggtgataccaaacagactcgtcaacgccgctgatcccgccaccacttttttctgcgcatcgcgttcgcagaggaagacgccgagcgccgccccgacctgcgccataatggcgggcattaacagcgggatcatggtgtcgtagcccagcacggtgaagttattgatacacagcggcaccaggccccagtgcagtccgaacatgacgaagatttgccagaagccgcccattaccgcgcccgcaaatgcaggaaccgcctgataaagccagagataaccggcggcaatcagttcgcttatccaggttgatagcggccccaccagcagaaaggtgacgggtgtgataaccatcagacatagcaatggtgtgaagaaatttttgattgccgacggtaaccacgcattaagtcggcgttccagaatgctgcacaaccaggcagaaaaaataatgggaataaccgatgacgagtaattcaacaatgtgaccggaatacccaggaaatccagccccagcgcatccgctttttgcccgttctcgaaagcagtcagaattaatggatgcactaacgctccaccaatcaccatggcagtaaatggattaccgccgaagcgtttccccgcggtgtatcccaggattatcgggaagaaccaaaacaaggcatcactggcgctgaataaaattaaataagtaccactttgttcggtcgtccactgaaaagtgagcgccagagccagcatacctttcaagatcccggttgccgccatcaaaccgatcagaggcgtaaaaatacctgaaataacataaacaaagcggtttagcagattacctttatcatcattttccggtgcctgttgcgctttttcgtcaaggcctgccacactgttaaccgccaggaagacatcggccacatggttacctatgaccacctgaaactggccaccgctttccaccaccataataataccgggggtctttttcagtacctctgcttgcgctttgctttcatcctttaatttaaaacgtaatcgcgttgcgcaatgcatcagactcacaatgttatctgcgcccccgactcctgcgactatttttctggctaactccgtcataacttgccctctaccgctttgcggcaaaactccaaaaaaaaacctgaaaaaaacggcctgacgtgaatcaagcaatttttttcaggttttgcccgcttagtgcggtaacaatcctttactcagtaataatatttcagtgttctttgcgcacgcgctctatatttatggctaaaaacataatctctgcgggtgaaattttacgttgatactgcaaaccaataaaaatggcgatccgttccgcacattgccatgcttgcgggtaattttgttttactgcttgttgtaatgattcatcactatcgttaattgaagcatgttcaagaatacgccaggataaaaacttcagatgtgtaaccagtcgctgataactcaagctttcttcctggtaattaaggctgaactgaaattttattaattgcagcatttcgcgcattaactgcgtgacacctgcaacatcctccatatttccgctcatttgggcactgaccagatgcatggcaataaagcccacttcatctttcggtaactgcacgcccaaccgtttatcaataatggttaacgcttcttcccctagctggaactctttcgggtaaagccgctggatatcccacagcaacgggttgggcagcaacacgttttgctgaaagcgtttaatcgcaaactggcaatggtcagttagcgagatataaatactgtcctgtaattttcccaagcgctcctgcgctaaagagataatacgatcacaggttgccatcacctcaagaggaatatgacttaagagttcgcttaatcgcccgttcagttcatgactgctcaaggcatactctttttctattccacttgagttaattctttcgccagcgcgtttttgaaagccaattccgcgccccatgacgactttttcccgctgttgatcatcaataaccaccacaacattattgttgagaattttggtgatttgcatgttcatagcaaggaccttttttataaacaaaaaaacccgacttcaccagtattctctggttatgtcaggttttgcctgcgaatgcagtaacaatccagtcatttattaatggtttttataacgaacatccaggttcggaaattaatttaattgcgtgcagagaaaatagcaatgcgctattgataaaaatatgaccatgctcgcagttattaactttgtgtaattttaggaatttataaagttatatataacaaatcccaataattaagttattgggatttgtctggtgaattatttgtcgctatctttccccgccagcagtttatccagctcatcgccaccgacgtgacggaaatcctgccccttcacgtagtagaagataaactcacaaatattctggcagcggtcgccaatacgttcgatagaacgcgcgcagaacagcgcagtaagtacgctcggaatggtacgcgaatcttccatcatgtaggtcatcagttgacgaacaataccttcgtattcctgatcgacttttttatcttcacgataaatacgtaccgcttcgtcaatgtccatccgcgcgaacgcgtccagcacgtcgtgcagcatctggatggtatgacggcccagcgactccagacttaccagcaacggctgatgctgctgggagaatttctccagcgcagtacggcagattttgtccgccacgtcgccaatacgctccagctcggcaatggttttactgatcaccataaccagtcgcaggtcgctcgccgtcggctgacgtttggcgataatgcgcacgcaggcttcatcgatcgccacttccatcatgttgacgttcttgtcgccttcgatgacgcgcttcgccagatcgctgtcctggttatgcatcgcggtgattgcatcagaaagctgctgctccaccatgccgcccatggtcatcacctgcgtgcggatactttccagttcggcgttgaactggccggaaatatgtttattaagattgagactgtccataacgcactcctgaatcaaccgtaacgaccggtgatgtagtcttctgtttgtttcttcgctggcttggtgaacagatcgtccgtgttgctgaactcaatcaattcgcccaggtacataaacgccgtgtggtcggaacaacgcgcagcctgctgcatgttgtgggtgacgatcaccacggtgtaatcctgcttcagttcggtgatcagctcttcaatacgcccggtagagatagggtcgagcgccgaacacggttcgtcgagcagcagcacttccgggcgaatggcgataccacgcgcaatacacagacgctgttgctgaccaccagagagagagtaaccgctctggtgcaatttatctttggtttcgttccacaatgcggctttggtcaatgcccactgcacgcgctcgtccatgtcggcacgggagagcttctcaaacagacgaacgccaaaagcgatgttgtcgtagatggacatcggaaacggcgtcggtttctggaacaccatgcccactttcgcacgcagcagtgcgatatcctgagagttggtcaggatgttgtcgccatcaagcagaatttcaccttccgcacgctgctccgggtacagttcaaacattttgttgaaggtacgcagcagcgtcgatttaccgcagccggacggcccgataaacgccgttacctggtttttagcgatatccaggttgatgtttttcagggcatggaatttgccgtagtagaagttcaaattacgaacctgaattttactcggggcagtttcaaccatactcattgcaatcttttcctcatcgtgcctgatgcacttcgctaatcaggcttaccgtaggccggatcaggcgttcacgccgcatccggcaaagtgttaaccgtgtacagagtcaaaaaggcgctcggtcggtcccctcgcccctctggggagagggttagggtgaggggaaaaccgtgtcagcaatatcaaccgtgtttattcttcgcaaaaacaacgcgcgccagaatgttcagcagcagtacgcacagggtaatgatcaataccccggcccaggccaattgctgccattccgcaaacgggctcatcgcaaacttaaagatcgtcaccggcaggttggcgatcggctgcatcatgtccgtgctccagaactggttggagagcgcggtaaacagcagcggcgcggtttcaccagcaatacgggcaatcgccagcaggataccggtcataatcccggacaccgacgctttcagcgtaatcgcagagatcatcttccacttcggtgtacccagcgcataagccgcttcacgcaggctgtacggcaccagtttcagcatgttctcggtggtgcggataacaatcggcacctgcaacaacgccagggcaatcacgcccgcccagccggagaagtgctccatctgcgccaccacaatggtgtaaacaaacagaccaaccacaatcgacggcgcagagagcagaatgtcgttaatgaagcgaatcacttctgccagccaggatttacgaccatattccgccagataaatccccgccataatgcccagcggcgtaccgaataccgtggcccacaaaattaacagcccgctacccgccagagcgttcgccagaccaccaccttccgtattgggcggcggcgtcatttcagtgaacagcgccagcgacataccgtcgataccgcgagtgatggtggacattaaaatccagatcagccagaacaggccgaaggccatcgtcgccatcgagagcgtcagcgcaatacggtttttgaggcggcgacgcgcctgcattttgcggcgagattcagccagcgccgcagtggtttgcatttcaaccatagccattagcgtgccccctcattcttagccaggcgcataatcataaacttcgatgcggcgaggacgatgaaggtaatcacaaacaggatcaggcccagttccatcagtgcggcaacgtgcagaccggattccgcttccgcaaattcgttcgccagcgcagaggtgatactgttgcccggcatatacagcgaggcgctgtcgagctggtaggtgttaccgatgataaaggtcaccgccatggtttcaccgagcgcgcggcccagccccagcatgatgccgccgataacaccatttttggtgaacggaagaacgatacgccagataacttcccaggtggtgcagccaataccgtaggccgactctttcatcatcaccggggtttgttcgaacacatcacgcattaccgccgcaatgtacggaataatcatgatggcgaggatcacgcctgccgcgaggataccgataccaaatgcggggccagagaacagcgcgccaacaatcgggatattcgacatgatattgccgaccggctcctgaaagtaaacggcgaacagcggcgcaaagataaacaggccccacatgccgtaaacgatacttggaatggctgccagcagctcaatggcgatacccagcgggcgtttcagccagccaggcgcaagctcagtcaggaacagggcgataccgaaactcaccgggacggcgatcagcagcgcgataaacgaagtcaccaacgtaccgtagatcggcaccagcgccccgtagatatcgttcggtgcatcccactctttggtccataggaaagccagaccaaatttctgaatgctcggccaggaggagatgatcagagagacaataatgccacccaacatcaatagcacaatcagcgccgccagttttaccagcacgctgaaaattatgtcgccctttttacccggtgggttaaaagcaggcttggttgcagccataagttactcttcagttaaacgcgtttacaaagtcattttgtaatgccggatgcggcgtaaaacaccgtacccggcctggagttttattagtacagcggcttaccgctactgtctttaatattggtcttccacgcagcgcgaacctgttcaactacactatccggcaggctggcgtaatccaggtcgttcgcctgtttagccccggttttgtacgcccagtcgaagaatttcagcacttctgtgccttgttctggtttcttctgatctttgtggatcagaatgaacgtggtagaggtaataggccatgcatcttcgcctttctggttggtcagatcctgagcgaaggttttgctccagtctgcaccttttgctgcattagcgaagttttcttcggtcggactaaccggtttaccatcagcggagatcagtttggtgtacgccaggttgttctgcttcgcgtaagcatattcaacataaccaattgcacccggcagacgctgaacgaacgcggcgataccgtcgttacctttaccgcccagaccgatcggccattttacggtagagccagtaccaacgttgtttttccactcttcgttcactttcgccaggtagctggtgaagacgaaggaagtcccggagccatctgcgcggcgtactacagcaatgttttgtgaaggcagtttcagacccggattcagtttggcgatggcttcatcatcccacttcttgattttgcccaggtagatgtcgccgagggttttaccatccagcaccagttcgccagacttcagccctggaatgttaaccgccagcaccacgccgccaatcacggtcgggaactggaacagaccttcctgagccagtttttcgtcagacagcggcgcgtcagaggcaccaaaatcaacggtattagcgataatctgttttacgccaccggaagaaccgataccctggtagttaactttattaccggtttctttctggtaagtgtcagcccatttggcatacaccggcgcagggaaggttgcacctgcacctgtcaggcttgcttctgcaaacacagagaaagcactcatcgataaggtcgcggcgacaacagttgcgacggtggtacgcataactttcataatgtctcctgggaggattcataaagcattgtttgttggctacgagaagcaaaataggacaaacaggtgacagttatatgtaaggaatatgacagttttatgacagagagataaagtcttcagtctgatttaaataagcgttgatattcagtcaattacaaacattaataacgaagagatgacagaaaaattttcattctgtgacagagaaaaagtagccgaagatgacggtttgtcacatggagttggcaggatgtttgattaaaaacataacaggaagaaaaatgccccgcttacgcagggcatccatttattactcaaccgtaaccgattttgccaggttacgcggctggtcaacgtcggtgcctttgatcagcgcgacatggtaagccagcagctgcagcggaacggtgtagaagatcggtgcaatcacctcttccacatgcggcatctcgatgatgtgcatgttatcgctacttacaaaacccgcatcctgatcggcgaagacatacaactgaccgccacgcgcgcgaacttcttcaatgttggatttcagtttttccagcaattcgttgttcggtgcaacaacaataaccggcatatcggcatcaattagcgccagcggaccgtgtttcagttcgccagcagcgtaggcttcagcgtgaatgtaagagatctctttcaacttcaatgcgccttccagcgcgattgggtactgatcgccacggcccaggaacagcgcgtgatgtttgtcagagaaatcttctgccagcgcttcaatgcgtttgtcctgagacagcatctgctcaatacggctcggcagcgcctgcagaccatgcacgatgtcatgttcaatggaggcatccagacctttcaggcgagacagcttcgccaccagcatcaacagcacagttaactgagtggtgaatgctttagtggatgccacgccgatttctgtacccgcgttggtcattagcgccagatcggattcgcgcaccagagaagaacccggaacgttacagattgccagtgaaccaaggtaacccagctctttcgacagacgcaggccagccagggtatccgcggtttcgccagactgtgacaaggtgatcatcaggctgttacgacgcacggcagatttgcgatagcggaattcagaggcgatttcgacgtcgcacggaatacctgctagcgattcaaaccagtagcgggaaaccataccggagttataagaagtaccacaggcgaggatctgaatatgctcaaccttcgacagcagttcgtcggcgttcggtcccagctcgcttaaatcaacctgaccgtggctgatgcgtccggtaagggtgtttttgatcgcgttcggctgttcgtagatctctttctgcatgtagtgacggtaaatgcctttatcgcccgcgtcatattgcagattggattcgatatcctgacgttttacttccgcgccagttttatcgaagatgtttaccgaacggcgagtgatttccgcaatatcgccctcttcaaggaagataaagcgacgggtcaccggcaacagcgccagctggtcagaagcgataaagttttcgcccatccccaggccaatcaccagcggactaccagaacgtgccgccagcagggtatccgggtgacgggagtccatgatcactgtaccgtacgcaccacgcagctgcgggatagcacgcagaacggcctcacgcagagtcccgccttgtttcagctcccagttcaccagatgggcaatcacttcggtgtcggtttcagaaacgaaggtatagccacgcgcttttagctcttcacgcagcggttcatggttttcgatgatgccgttatgcaccaccacaatgtgttcagaaacatgcggatgcgcattcacttctgaaggttcaccgtgggtcgcccagcgagtgtgagcaataccagtgccgccatgcagaggatgttcttccgctgcctgtgccagcatctggactttaccgaggcgacgcaggcgggtcatatgaccttctgcatcaacaacggccagaccggcagagtcatatccgcggtattccagacgacgtaaaccttcaagaaggatttctgctacatcacgttgcgcgatcgcgccaacaattccacacatagtttttgattccgatttatatcgttgtcggtcaacctgtatgcccgttttttcgggcgccccgagccttgtagagagtggggttatttttatagttactgcttgtgggagggagattatgttatctcctcatcccatgtgaccgggttagccggccagaatcactttttctttaccggacgacgccagccttctttctgagtctgcggcacacggctgatagctaatgcattttcgccgacattacgcgtcacagttgtacccgcagcaatggtcgcgcctttgcctactgttaccggggccaccagctgagtgtcggaaccaacaaacacatcgtcgccgataatggtcttaaatttattcgcaccatcgtagttgcaggtaatggttcccgcgccgatgttaacgttatcgccaatttccgcatcgcccaggtaagtcagatgaccagctttcgagcctttacccagacgcgcttttttcatctcaacgaagttaccgacgtgagcaccttccagcaactcagcaccaggacgcaaacgggcaaacgggccaatggtacaggccgctgccagattcgcatcttccacaacggtatacggactgatttcgcaatcatcgccaatcacgctgtttttaatcacgcaaccggtgccaattttcacgcgatgaccgagagtcacgttgccctcgatgataacgttagtatcaatttcaacatcgcgcccgtgagttagcgtaccacgcagatcaaaacgcgctggatcgcgcagcataacgcctgctaacagcagtttttcagcctgttcggactgataaacacgctccagacgggagagttgcaggcggttattcacgccttctacttcgcttaaacgttgcggatgaacggcgacgatttcacgcccttcctgatacgccagcgcaataatgtcggtgatgtagtattcgccctgagcattattgttggtcagcttcgccagccagcgtttcatatctgcgccgttggcaatcagaatgccggtgttgatctcctgaatctgacgctgctcgtcggtggcatctttgtgctcaacaatgccggtaactttgccgttttcacgggtgatacgtccataaccggtcggatcatccagtttcaccgtcagcagaccaatgccaccctgcggtttagcatcacgcagacgctggagtgtttcgacagagatcagcggcacgtcgccgtagagcattaaaatgtcttcatcatcggcaaagaaaggtgcggcctgctgcattgcatgacccgtacccagctgctctgcctgaagcacccagttaaggttgtcgtctttcagcgcctgttttagcagatcgccgccgtgaccgtacaccaggtgaacgtgcgctgcgcctaattcattcgcagcatcaatgacatgctgaaccatcgctttcccggcaagggtatgcagcactttcggaagatcggaatacatgcgcgtgcctttgcctgcggcaaggatcactacgctcatagcattattcaacatacgcgtcctgactgtaatttgagaacgaatttaaaccgcttcaccttgaaaaaactacatttttttcatcgtgaaatggacagaggataaattgttcaataacggattatccccgctgacgaaagcgccattttcgaccatcgtcacgccttttgtctgcagaaaattaaggcagtaccttaatttaagcgtcaggtggatgtttttgctcttatttcgatcaatgaataaacaggaaaacaggggggttttatatcagcaggatctatgtgaacgctattcaggacgggtcacacgcgcaaaaaaaagccagcctgtttccagactggcttttgtgcttttcaagccggtgttacatcgcttttttggtcaactcgataacgcgcagctgcgcgatcgctttggccagttccgcagacgcctgagcgtaatctacgtcgccgtgagagctgctaatgtgctcttcagccttacgtttcgcttccatggctcgcgcttcgtcgagatcctggccgcgaattgcggtgtcggccagaacggtcacgttgccaggctgcacttcaagaatgccgccagacagatagataaactcttcgtgaccgtgctgtttcacgatgcgaatcataccaggcttaatggcggtgagcagcggtgcgtggccagggtagatccccagttcaccttcgctacccgttacctggattttctcgaccagaccagagaacatttgttgctctgcgctgacgacgtccaggtggtaagtcattgccatatcaccctccgattaaggcgttaaagttttttggctttttccacagcttcttcgatggaaccgaccatgtagaacgcctgctccggcaggtgatcgtattcgccttccatgatgcctttaaagccacggatggtgtctttcagggagacgtatttacccggagaaccggtgaatacttctgccacgaagaacggctgggacaggaagcgctggatcttacgagcacgcgctaccaccagtttgtcttcttcagacagttcatccatacccaggatggcgatgatgtctttcagttcctgataacgttgcaggatggactgaacgccacgcgcggtgtcgtagtgttcctgaccaaccaccagcgggtccagctgacggctggtggagtccagcgggtcaacggccgggtagatacccagagacgcgatctgacggctcagtaccacggttgcgtcaaggtgcgcaaaggtggttgccggagacgggtcagtcaagtcatccgcaggtacgtatactgcctgtacggaggtgatagaaccagttttggtggaggtgatacgttcctgcagaacgcccatctcttccgccagggtcggctgataacctaccgctgaaggcatacggcccagcagtgcggatacttccgtaccggccagggtgtaacgatagatgttgtcaacgaacagcagaacgtcacgaccttcgtcacggaatttctcagccatggtcagaccggtcagagcaacgcgcagacggtttcccggcggctcgttcatctggccatacaccagggatactttgtcgataacgttggagtcggtcatttcgtggtagaagtcgttaccctcacgagtacgttcacctacgcccgcaaacacagagtaaccggagtgctcgatcgcgatgttacgaatgagctccatcatgtttacggttttacctacacccgcaccaccgaacagaccaactttaccgcccttagcgaacggacacatcaggtcgataactttgataccggtttccagcagttcctgagagtttgacagctcttcgtaggaaggtgctgcgcggtgaatcgcccaacgctcttcttcaccgatctcgcctttcatgtcgaccggttcacccagtacgttcatgatacggcccagagtcgctttacctaccgggacttcaatcgggtgttcgaggtcttttacatccagaccgcgacgcagaccgtcggaggaacccattgcgatggtacgtacgataccgccgccgagctgctgctgaacttccagcaccagacgctcattaccattttgcacctcaagagcatcgtacacgcgcggtacggcatcctgagggaattcgacgtcaactacggcgccgattacctggacaatctttccagtagccatcttaaatcctctacgaaataacctgtttaaaccgcggcggcccccgagacgatctcggtgagttcctgagtaatgctggcctgacgagctttgttgtataccaactgcagctctttaatcaggctgccgccattgtcggtcgcggctttcatcgccaccatacgggcggcctgctcgctggccaggttttcaaccacgccctgataaacctgagattcgacataacgacgcagcagggtatccagcaacgccttcggatcgggttcgtacaggtaatcccaggatttatgtttcagatcatcatcatctgatgccggtaacggcagcagctggctgatggtcggaacctgagacatggtgttaataaatttgttgctgacaatgtaaagcttgtccagacggccttcgtcgtaggcctgcaacatcacttttaccggaccgatcagttcggacagggaagggttatcccccatgccggtgacctgggcaacaacattgccgcccacggagttgaagaacgacacgcctttcgagccgatcattgcgaggtcgcattgaacgcctttgtcggtccaggtcttcatttccgccagcagttttttgaacaggttaatgttcaaaccaccgcacaaaccacggtcggtcgacaccaccaggtagcccacgcgtttaacgtcgcggtcttccaggtaagggtgcttatattccagattaccgtgtgcaaggtgaccaatcactttgcgcatggtttctgcataaggacggctggccgccatgcgatcctgcgatttacgcattttggaagcggcgaccatctccatcgctttagtgatcttttgcgtgttctggacgcttgcgatcttactacgtatctcttttgcgccggccatgagcttctcctcaatgccttgcggcctgccctaaggcaagccgccagacgttaccaggattgggttgctttgaaggaatcgaggatgcctttcagcttgccttcgatttcgtcgttgtagccaccggtctggttgatctcttgcatcaacggagcgtgatcacggtcgacgtaagccagcagagcggcttcgaagctgccaattttcgacagttcaacatccgccaggtaaccacgttctgctgcgaacagaaccagagactgctgcgcaacggacatcggcgcatactgtttctgtttcagcagttcggtcactttctgaccgtggtcaagctgcttacgtgttgcatcgtcaaggtcggatgcaaactgagagaacgctgccagttcacgatactgtgccagagcggtacggataccaccggacagttttttcatgatcttggtctgtgctgcaccaccaacacgggatacggaaatacccgggttaaccgcaggacgaataccggcgttgaacaggttggtttccaggaagatctgaccatcggtaatggagattacgttggtcggaacgaacgcagaaacgtcacccgcctgagtttcgataatcggcagtgcggtcagagaaccggttttccctttcacttcacctttggtgaaggcttcaacgtattcggcgttaacacgtgcagcacgctccagcagacgagagtggaggtagaaaacgtcgcccgggaatgcttcacgtcctggcggacgacggagcagcagggagatctgacggtaagcaacagcctgtttagacaggtcatcgtaaatgatcagcgcatcttcaccgcggtcacggaagtattcgcccattgcgcaaccggcatacggtgccaggtattgcagtgcagcggattcagacgcggttgctaccacaacgatggtgttagccagtgcgccgtgctcttccagtttacgtaccacgttagaaatggtggacgctttctggccgatagcgacatagatacatttgataccggaatcgcgctggttgatgatggcatcgatagccagtgcggttttacctgtctgacggtcaccgatgatcaattcacgctgaccacgaccgattgggatcatggagtcaacggctttataaccggtctgtaccggctgatctacggactgacgttcgataacgcccggagcgattgcttctacagcagagaagccgtcgtgatccagcggacctttaccgtcgattggtgcacccagagtgttaaccacacggcccagcaggccacggccaaccggaacttccaggatacggccagtacacttaactttcatgccttcggcaaggtcagcgtacggacccataacaaccgcacctacagagtcgcgctcgaggttcagtgcgatagcgtaacggttacccggcagggagatcatttcaccctgcatacaatcggccaggccgtgaatgcggataacaccgtcacttacagaaacaatagtaccttcgttgtgagcttcactcacaacattgaactgagcaatgcgctgcttgatcagttcgctgatttcggtggaattcagttgcatgctccagtccccttaagactgcaagacgtctgcaaggcgctcaagacgaccgcgtacgctgccatcaatgaccatatcacccgctcggatgataacgcctgccattacagacttatcgattttgcaattcagcttaactttgcgtgacagacgtttttccatcgcagcagaaattttcgcgagctgttgttcactcagtgcggcagcggaaatgacgtctacctcagcggtagcctcactcacggcacgcaggtgaataaactgctccagaacatccgggagcgcgttaagacgaccattttcagccataacccgaatcaggttctgaccgttttcgtccagttgctcaccacaaactgcgataaacgactcggcgagcgtttctggcgcaagcgcgccagagagaagctctgccatttgttcgtttttggttacctcggcggcaaacgccagcatgtcctgccagcgttctacactttggtgttcgacggcaaagtcaaaagctgctttggcgtaggggcgagctaccgtaataaattcagacatcagcccctccctccttacagttcagcgacaagtttatccacgatgtcgctgttagcagcttcatccacggaacgttcgatgatcttctcggcgccagcaacagccaggatagcaacttgcttacgcagctcttcacgggcacgtttacgctcggcttcaatttccgcctgcgcctgggccacgattttagtacgttcctgttctgcctcagctttcgcttcgtccagaatctgcgagcggcgtttgttcgcctgctcgatgattacctgggcttccgctttcgcttttttcagctggtcggtcgcgctggcctttgcaaggtcaaggtccttatgtgctcgttctgcggaagcaaggccgtcagcaatttctttttgacgtttttcgatggctgccattaatggcggccatacgtacttcatgcagaacagaacgaacaggacaaacgcgatggcctggccgaggattgttgcgttaagattcacagcacaatgcctctatttagttaacgttctgatattgctctttaaataaaagcaacgcttactacgcgacagcgaacatcacgtacagacccagacctacagcgatcatcgggatagcatccaccagacccataacgataaagaactgagtacgcagcagaggaatcagatcaggttgacgcgctgcgccttccaggaatttacccccgaggatgccgataccgatcgcagcaccgattgccgccagacccatcatcacagcggcagccatgtacagcagatccatattcaggttttccatgacagtctccagtttgtttcagttaaaacgtagtagtgttggtaaattaatgttcttcagacgccatcgacagatagacgatcgtcagaaccatgaagatgaaggcttgcagcgtaatgatcaggatgtggaaaatggcccacggcacattcaggatccactgtgaccaccacggcaacagaccagcaatcagaatgaaaatcagctcaccggcatacatgttaccgaacagtcgcaaaccgagtgaaactggtttggacagcaggcttaccccttcaaggattaagttgacaggaatgaacgcccagtgattgaacggctgcagcgtcaactctttcgtgaagccgccgatgcctttcattttgatgctgtagaacagaatcaggataaatacgcccagtgccatagacagcgttacgttcacgtccgcagacggaaccacacgcagtgcaggcagacccagtacatgttcagcaatgtacggcagcaggtcgataggcagtaaatccatcaggttcatcaggaatacccagacgaagatcgtcagggccagcggagcaatcagcttgcttttgccatggtacatgtctttcacgctaccattaacaaagccgatcaccagctcaatcgcggtctgaaacttacctggcacaccgctggtcgcctttttggctacgctacggaataaaaccaggaacaacagacccagcaccaccgagaagaacatggagtcaatattgattgtccagaaggtggctggggggttttgtggatccaccagcgagaatgtacgcaggtccagctgaaggttattcaggtggtgtcctatgtaatcctgcggcgtcatattttctgaagccatgatgccttttaccctttgttgttaattacagccggtgccagtatctgaaccaccagcaccaaaacccacgtaacgatcagcggcaagaataccgcctttaaaaccgccaacgccaccaccagtaacaccaacatcgccagaactttgaaagcttcgccaaatgcgaatgtccaggccacccggcctttcgctggtgtatgcgcctggtgacgccaggcaaatatcataaacaaaacgttaggcagaaagactgccaggcccccgcttattgcagagacgccccagaaggggtctttgaggctgaacagcaatccacttgctatcaccaccagtaactgaacgagcagaagcttccgagcaacgtttcgactcacgagcgacacagacatcacgtttttcactcctgctcccttcgaggtatgccgcgtgtcgtataaaactttctttaaggcttagagtcaagcatcaaaaagcggtcaaattatacggtgcgcccccgtgatttcaaacaataagtagccaaaaggtgaataaatgtttaaatatttttccagtgcatacaattgcgacttttctgctaaccctgttcgatcatgaaaaactgtaaataacgcgtaaacactggtgataaagcgtgcttcagatcacatattgcgcatgttcgcgcacagcatatttatttacttggcaaatgatgcctttgcaagtttatgatatttcagtctaaaaacagatactgttttaataaatgacatttacacaacaaaaaccacccattgacatttttaataatgttttaacagccaatgatggttcttagcgccgatttttagcagactgatattttcactaatgacttattttctgcttaccaaaaaaagccacgttatcttgttgatgcaaaagagtgaacgtggcgttaaatgtaaccagttatatcagtagaaaacctggttgttgttaacagtctaaccggtcaattttttatgatttttttgataaaaattaaattttatttgctttaatcaccaccagatgacgttcgccatccagggctggaacctgaagtttaaccactgattcgacctgatattcttcgggcaacaaagcgatttcatcttccggcatttgccctttcagcgcgtagaaacggccttgctcaccaggaagatggtggcaccagctcaccatatcgttcagagaggcaaaagcgcggctaattacgccatcaaatggcggctctgaaggaaactcttctaccctgctctgtactggttcaatattctccagtttaagctcatgttgcacctgacgaaggaaacgcacgcgtttaccaaggctatccaacagagtgaaatgggcttcaggacgcacgatagagagtggaatgcctggcagtcctggtccggtgccgacatcgataaaccgttcaccttgcagatacggtgccaccacaatgctatcgagaatatggcgtaccagcatctcattaggatcgcggaccgaagtcaggttgtacgctttgttccatttatgcagcatattcacgtaggcaataagctggtttttctggtgatcggtaagcgaaatacctgcgtctttcagcagtaaggagagtttgttgagcacggtgattacctgttcttgatgcgttgcctggtaagcgggtgcttaccaggcatttttaatgcgttatgcgctacgacgcagcataccctgttttttcagccacaccagcagaatggagatggccgcaggcgtgacgccagaaatacgcgaagcttggccgatagaggctggtttgtgatcgttaagtttggcgatcacttcgttagaaagaccggatacctggcggtaatccagtgtcgcgggtagcagggtgttctcgttacgcagctgcttttcgatctcatcttgctggcgcgcgatataaccttcgtatttaacctgaatctcaacctgttccgccgcctgttcgtctgtcaacgcaggggcaaacggcgtcagcgtggttaatttttcataagtcatttccggacgacgcagcagatcttcaccactggcttcacgggaaagcggcgcagtcaggtgagcattcacttcggctgcagcttccgccgacggggttacccaggtcgatttcagacgctgacgctcacgctcgatattctcaagtttctcgttaaagcgcgcccaacgttcgtcatccaccaggcccagttcacgaccgatttcagtcaaacgcagatccgcattatcttcgcgtagcatcagacgatattctgcgcgcgaagtaaacatacgatacggttctttggttcctaaagtgcacaggtcatcaactagtacgccgagatacgcctgagaacgtgccggagcccaaccttctttgtcagcagacagacgggcagcgttaagaccggccagcaaaccttgcgcagcggcttcttcgtaaccggtagtgccgttaatctgaccagcaaagaacagcccctggataaacttgctctccagcgtcggtttcaggtcgcgaggatcgaagaagtcatactcaatggcataacccggacgcacgatcttcgcgttttccatcccctgcatagagcggacgatttgcatctgcacatcgaacggcaggctggtggagataccgttcggataaatttcattagaggtcagtccttccggttcaaggaagatctgatgctgatttctgtcggcgaagcgcatgactttgtcttcgatcgacgggcagtagcgtgggccgacaccttcgatcacccctgcgtacattgggctacgatcgaggttactgcggatcacatcatgggttttctcgttggtatgagtgatataacacggcacctgctggggatgctgggacgcattgcccataaacgagaataccggcattgggttatcgccatgctgttgcgccagtacgctaaagtcgatggttcgagcatcaatacgcggtggtgtcccggttttcagacgaccaacgcgcagcggcagttcacgcaaacggcgagaaagcggaatggacggcggatcaccagcacggccaccgctgtaattatccagaccgatatgaattttaccgtcgaggaacgtcccaacggtgagcacgacggctttggcacggaacttcagtcccatttgggtaacagcaccgaccacgcgatcgttttcgacaataagatcttcaaccgcctgctggaagatcatcaggttcggttggttctccagcgccgtacgtaccgcctgacggtagagcacacgatccgcctgagctcgggtagcgcgaaccgccggtcctttgcttgcgtttagtatcctaaactggatacccgcctgatcgatcgctttcgccatcagaccgccgagtgcatccacttcttttaccagatgtcccttcccaataccgccgatcgccgggttgcagctcatctgccccagagtgtcgatattgtgtgtcaaaagcagagtctgttgacccatacgcgccgcggccatcgcggcctcggtgcctgcatgacccccgccaatgatgatgacgtcaaaaggatccggataaaacatggtgattgcctcgcataacgcggtatgaaaatggattgaagcccgggccgtggattctactcaactttgtcggcttgagaaagacctgggatcctgggtattaaaaagaagatctatttatttagagatctgttctattgtgatctcttattaggatcgcactgccctgtggataacaaggatccggcttttaagatcaacaacctggaaaggatcattaactgtgaatgatcggtgatcctggaccgtataagctgggatcagaatgaggggttatacacaactcaaaaactgaacaacagttgttctttggataactaccggttgatccaagcttcctgacagagttatccacagtagatcgcacgatctgtatacttatttgagtaaattaacccacgatcccagccattcttctgccggatcttccggaatgtcgtgatcaagaatgttgatcttcagtgtttcgcctgtctgttttgcaccggaatttttgagttctgcctcgagtttatcgatagccccacaaaaggtgtcatattcacgactgccaataccgattgcgccaaagcggactgcagaaagatcgggcttctgttcctgcaatgcttcatagaaaggagaaaggttgtccggaatatctccggcaccgtgggtggagctgataaccagccagatccctgaggcaggtaaatcttctaacagcggaccgtgcagcgtttcggtggtaaaacccgcctcttccagcttttcagccaggtgttctgctacatattcggcaccgccgagggtgctgccgctgataagagtgatatctgccataaaccgccacctttattaagagtggcgtattgtacgctgtgaacgcgttgggatctacctgtggaaaagtatgggattaaaaaagccgatcagggcttgatggtacgcatgatcgggttttgcaggacgatcaatgtctcggtggactgaatttcatcaattgtttggatcttgttgataagtacatgctggagagcgtcgatcgaacggcacatcacttttataaagatgctgtagtggccggttgtgtaataggcttcagtgacttcatcaaggctttccagctttgccagcgcggaagggtagtctttggcgctctttaatataatgccgataaagcagcctacgtcataaccgagctgcttcgggctgacatcaatacgcgccccggtaatgatccccgcctgcttcattttctctactcgaacgtgaatcgtccccggactgacgccaaattgtttcgccagttcggcgtaagcggtgcgcgcattgcccattaatgcttccaggatgccacggtccagattgtcgatcagataattttccataggattttcttatgcggattgatgattcattctattttagccttcttttttaatgaatcaaaagtgagttaggctttttattgaatgattattgcatgtgtgtcggtttttgttgcttaatcataagcaacaggacgcaggagtataaaaaatgaaaaccgcttacattgccaaacaacgtcaaattagcttcgtgaaatctcacttttctcgtcaactggaagaacgtctggggctgatcgaagtccaggcgccgattcttagccgtgtgggggatggcacgcaggataacttgtcgggctgtgaaaaagcggtgcaggtaaaagtgaaagctctgcctgatgcccagttcgaagtggttcattcactggcgaagtggaaacgtcagaccttagggcaacacgacttcagcgcgggcgaagggctgtacacgcacatgaaagcccttcgccccgatgaagaccgtctttctccgttgcactcggtctatgttgaccagtgggactgggaacgcgtaatgggcgacggtgagcgtcaattctcgactctgaaaagcacggtagaggcgatctgggcgggaattaaagcaaccgaagctgcggttagcgaagagtttggcctggcaccgttcctgccggatcagatccacttcgtacacagccaggagttactgtctcgttatccggatcttgatgccaaagggcgtgagcgggcgatagcgaaagatcttggcgcggtattccttgtcgggattggcggcaagctgagcgatggtcatcgccacgacgtgcgcgcaccggattatgatgactggagcaccccgtcagagctgggccatgcgggtctgaacggcgatattctggtgtggaacccggtactggaagatgcgtttgagctttcctccatggggatccgtgtagatgccgacacgctgaagcatcaactggcgctgaccggtgacgaagatcgcctggagctggagtggcatcaggcgctgctgcgcggtgaaatgccgcagaccatcggcggcggtatcggccagtctcgtttgactatgctgctgctgcaactgccgcatatcggccaggttcagtgtggagtatggccagctgctgttcgcgagagcgtcccttctctgctgtaataatttatcgccgccagcgtctgagcaggcggcttcgcatcccggtatcaaagcgccagatatgatcgaaaatgcgcatgatgccgggtttgccgtgtgccgacatcgccacggcatgaaagcgatgctgatgtacccgctgcagctctttcactttactcgtcacgtcgtcaggcaaccgctgagcgataaaatcagaaatcaccaccgcatcggcatcaaaccattccctgctttgcaagcgttccataatggcgcgaaaacaactggcaagatcggtgccgccacgaaactgctggcttaaaaaacggattgcttgttcgatgccttgtgggcctgaaagctcataacggacgatctcggtggaaaatagcataatatagcagcgccggttttctgcgagagcaatgcgcatcaaggccaggcagaacgctttcgcacactgttcattaaagccgcccattgagccggaagtatccacacagacaataaacggcccgcgcggctgttcatcgtaatctttatgtaccaccggacgttcgatcactttttcacgccacgactcaccgtgcaggcgataggtgagcaactgtttttccaccagccgacggtaaaactcatactccagttccgttatccctagtgtcgccagttctggcggcaggagacgtaaaatatcatcgctttgttgcagaccatcaacctgctcaggaaccgtcgccggttcgcgcaccatggtgcggaaggtttccatctgcgcatcgttgcgcggtattgatttggcttcccgagaacgccccagctgctctgccaggcgtttcagttccggctgttcgttaagaaattcaccgtatttcacaatcaactgatagtcgccacgtttaagctgaccggcgctcatatcccacagacgaccagctgcagtattgttatctgcgagaatcggttcaagttgtccgctcagcgtcatgcgttcctgaacttcactcaacagttgttcgcgttcttcttctaatagctgttgatttaacgtcgttgcttgcacgatcagacttaaacgccaacgctggagaaaaagcgtgtgtaacgctgaagtgatcgtgctgttagcatcaaccaactgtcgggcttgttctgcccatggagaattcagacgatgcagtaagtccaggatctgtggtagctgcacaataaactgtggcgtggagaggagctggctttgctgatagcacatcacctcttcggtgagttccggcgggactcgggcatctttcagccgactgcgcagcgcttcacgccagcggggaacatcatcagtgattgccgccttcaggcgtgggaatttttcaaagaagaccgccagctgcggtgaggccagcagtgcgatgatcatctcttcgatcaatccctcttcgctgacggccagcatcacattaagcgtatccagcgttagcattgttgtgcctggcgaatctgtgcaccgacatcctgtaggctggcttcaatgcgacctaaccagtcgccagggataaacagacatttttgctgttcgctgaataaagcgtgttgcttgcgccagtcgctttcaagctcttccagttgttgttttatttcaccaggcagaccttcagccgatgaaccgggaagtgccagcgtactgccttgtaaacttacatcgcgaacgacaagatgttgggcgctatcaacttccagattcagtttctgggcaaagccgataccgttcagtttaccgcgaatttcaccacctttgctcagccactgttccagcgcgctacgctcaaaggagatatgaaccacttccatatcatgcagttttaacggtttttgcagcagtagagtcagagtggaagcagtaacgttaacaggaagttgatactgctgacgacggctgaaaatgccgcccagacgaattaccgttaaggctgttttatcgctttgttgctgctggagttgcaggtgacgttgcacaatcgcgccaaggcgagtcaacatcccttgctgttgccaggcgtgaccggtcatcaatacatcaatttgttgttgtatcaaattcaggctttgcgcgtcataccacaggcaatctttcagcaaaatgagatctaccggggcaacagcactgcgaccgctaaaaaaggcgctggcctgcaataatcggatcgcttttttccagcgacgatccgagacataaggcgcatccggtaatttatccagttgctggcgcagcataaaaatcagctcaaatacatgatcgggcagcgtaatttcaccaatctctttctgccagcgttcatattcttcatctgtgacctgcaaggcatcaggaaccggattgtcgttttcatcctgttgactggtcagcatggagcggaaattcgctttatcctgcactttatctaaccacagacgaatcagcatgcggtcatataacgcttccagactgctgtctgcttccggcagctcgttggaggccgccaccagcagacgcatcgggattttttctacgtgtgcaccgttgcggaactggcgctcgttaatggcggtgagcaaggtattaagaattgccgggcccgctttccagatctcatccagaaagacaatttctgcttccggcaggtaaccgctggttaaacgttcatagcgcccttcatcttttagcgcctgaatagaaaggggaccaaaaacttcttccggcgtggagaagcgggtcatcagatattcaaacgcgcgggcattctgaaaggcgaattttaagcgccgggcgatcaaacttttggcaatacctggcgggccaaggaggaacacactttcaccacttaatgccgctaataaacacaagcggatggcgtggctacgttcataaagccccttttccaacgaactgctcaggcgggaaattctttccgctaataaatgagggtgagccataatgaagtggcgtcctttcgtcaaaagttctgcgtaaattgcgagtatagacgtttcttgctggtggctaaaatagtctcaaagggggggtatttttctttgagccaggttaatgtggccgcatttaggagtacgattttgccgttaatcgtgcatactgtgcgcttttttgtgggccaagggactaagcacacatttcatatttcaacgaaagactagtctatgagcactgataataagcaatcattgcccgcgattaccctcgcggcgattggagttgtctacggcgatattggtaccagcccgttatatacacttcgtgaatgtttgtccggccagtttggttttggcgttgaacgcgatgccgtgtttggctttttatcgctgatcttctggctgctaatctttgtggtttccattaaatatctcaccttcgtgatgcgggcagataacgccggtgagggggggatcctgacgttgatgtcgcttgccgggcgtaatacgtcggcgcgaaccacatcaatgctggtgattatggggctaatcggcggcagctttttctatggtgaagtcgtcataacacccgctatttcggtgatgtcagccattgaaggtctggaaatcgtcgccccgcagctggatacctggatagttcccctctcaattatcgttctcactttattatttatgattcaaaaacatggcacggctatggtcggtaagctgtttgcgccgatcatgctgacctggtttttgattctggcaggactggggttacgtagcattattgctaacccggaagtgctgcatgcgctgaatccaatgtgggcggtgcatttcttccttgaatacaaaacggtttcttttattgcattaggggcagtggtgttgtcgattacgggggtcgaggcgctgtatgctgatatggggcactttggtaagttccctattcgcctggcgtggttcaccgtcgtattaccttccttgacccttaattacttcggtcagggagcgctgttgttaaagaacccggaagcgattaagaacccgttcttcctgttggcaccggactgggcgctgatcccgctgctgatcatcgccgcactggcgacggtaattgcctcgcaggcggttatctctggcgtcttctcattgacgcgtcaggcggtacgtctgggatatttgtcgccgatgcgcattattcacacctccgaaatggagtcagggcaaatctatattccgtttgtgaactggatgctctatgtcgcggtcgtgattgtgattgtcagctttgagcactccagcaacctggcggcggcgtacgggattgcggtgaccggaaccatggtgctgacgtctattctctcgactaccgtggcacgtcagaactggcactggaataagtattttgttgcgctgatcctgattgctttcctttgtgtcgatattccattgttcaccgctaacctcgataaactgctctccggcggctggttgccattgagcctcggtactgtgatgtttatcgtgatgaccacctggaagagcgagcgtttccgcttgctgcggcggatgcatgaacatggtaactctctggaagcgatgattgcttcgctggagaaatcaccgcctgttcgcgtgcccgggaccgcggtgtatatgtcgcgtgcaatcaacgtcattccctttgcgctgatgcataaccttaaacataacaaggtattgcatgagcgggtgattctgttaactctgcgcaccgaagacgctccatatgtccataacgtccgtcgggtacagattgaacaactgtcgcccactttctggcgcgtggtggcaagttatggttggcgagaaacgccaaacgtagaagaagttttccaccgctgcggtctggaaggattaagttgccggatgatggaaacctccttctttatgtcgcatgagtcgttgatcctcggcaaacgcccgtggtatttgcgtctgcgcggcaagctgtacttgctgctgcaacgtaatgcgctgcgtgcaccagatcaatttgaaatcccgccaaacagggttatcgaactgggtactcaggtcgaaatctaacgccagacgcctcctttcttcataagggggcgtttttgttttcatggttaatcaccatgtaaaacgtttcgaggttgatcacatttccgtaacgtcacgatggttttcccaactcagtcaggattaaactgtgggtcagcgaaacgtttcgctgatggagaaaaaaatgaaaaaaggcaccgttcttaattctgatatttcatcggtgatctcccgtctgggacataccgatacgctggtggtgtgtgatgctggtttacccatccccaaaagtacaacgcgtatcgatatggcattaacccagggtgtaccttcttttatgcaggtgctgggcgtcgtcacaaatgaaatgcaggtcgaggcggccattatcgcggaagagatcaaacaccataatccgcaactccacgaaacgttgctcactcaccttgagcagctgcaaaaacaccagggaaataccattgaaattcgttacaccacgcatgaacaattcaaacaacaaaccgcagaaagtcaggcggtaattcgcagcggagaatgttctccgtatgcgaatatcattctctgtgctggcgtgacgttctgaggccgtcatggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggcatctatactcgcgatgccggtacgcttttatggctggggaaagaaacgacatttaccgggccaaaatcttcccaggaagccgggattgggattatccatcaggaactgaacctgatcccgcagttgaccattgccgaaaacattttcctcggtcgtgagtttgttaatcgctttggcaaaattgactggaaaaccatgtatgccgaagcggataaattgctggctaaacttaacctgcgctttaaaagcgacaagctggtgggcgatctttccatcggtgaccagcaaatggttgaaatcgccaaagtgctgagctttgagtcgaaagtcatcattatggatgaaccgaccgatgcgctgaccgataccgaaaccgaatccctgttccgcgtcatccgcgagctgaaatcgcaaggccgcggtattgtctatatctcccaccgcatgaaagaaatcttcgagatttgcgatgacgttaccgtttttcgtgatgggcaatttattgctgagcgcgaagtggcatcactgaccgaagattcgctgattgagatgatggtgggtcgcaagctggaagatcaatatccgcacctggacaaagcgccgggagatatccgcctgaaagtcgataatctctgcggacctggcgttaacgatgtctcttttactttacgcaaaggcgaaattcttggcgtctctggtttgatgggcgcaggtcgtaccgaactgatgaaagtgctctacggcgcactaccgcgcaccagcggttacgtcaccctggatgggcatgaagtcgttacccgttcaccgcaggatggcctggcaaacggcattgtgtatatctccgaagaccgtaaacgtgacggtttagtgttgggcatgtcagtaaaagagaacatgtcgctgacagcgctgcgctacttcagccgcgctggcggcagtttgaagcatgccgatgaacagcaggctgtgagtgatttcattcgtctgtttaatgtgaaaactccgtcgatggaacaggcaattggtctgctttccggtggcaatcagcaaaaagtggcgattgcccgcggtctgatgacacgccccaaagtgttgatccttgatgaacctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaaaaaaatgacaacccagactgtctctggtcgccgttatttcacgaaagcgtggctgatggagcagaaatcgcttatcgctctgctggtgctgatcgcgattgtctcgacgttaagcccgaactttttcaccatcaataacttattcaatattctccagcaaacctcagtgaacgccattatggcggtcgggatgacgctggtgatcctgacgtcgggcatcgacttatcggtaggttctctgttggcgctgaccggcgcagttgctgcatctatcgtcggcattgaagtcaatgcgctggtggctgtcgctgctgctctcgcgttaggtgccgcaattggtgcggtaaccggggtgattgtagcgaaaggtcgcgtccaggcgtttatcgctacgctggttatgatgcttttactgcgcggcgtgaccatggtttataccaacggtagcccagtgaataccggctttactgagaacgccgatctgtttggctggtttggtattggtcgtccgctgggcgtaccgacgccagtctggatcatggggattgtcttcctcgcggcctggtacatgctgcatcacacgcgtctggggcgttacatctacgcgctgggcggcaacgaagcggcaacgcgtctttctggtatcaacgtcaataaaatcaaaatcatcgtctattctctttgtggtctgctggcatcgctggccgggatcattgaagtggcgcgtctctcctccgcacaacccacggcggggactggctatgagctggatgctattgctgcggtggttctgggcggtacgagtctggcgggcggaaaaggtcgcattgttgggacgttgatcggcgcattaattcttggcttccttaataatggattgaatttgttaggtgtttcctcctattaccagatgatcgtcaaagcggtggtgattttgctggcggtgctggtagacaacaaaaagcagtaataacgactacaggacatcttgaatatgaacatgaaaaaactggctaccctggtttccgctgttgcgctaagcgccaccgtcagtgcgaatgcgatggcaaaagacaccatcgcgctggtggtctccacgcttaacaacccgttctttgtatcgctgaaagatggcgcgcagaaagaggcggataaacttggctataacctggtggtgctggactcccagaacaacccggcgaaagagctggcgaacgtgcaggacttaaccgttcgcggcacaaaaattctgctgattaacccgaccgactccgacgcagtgggtaatgctgtgaagatggctaaccaggcgaacatcccggttatcactcttgaccgccaggcaacgaaaggtgaagtggtgagccacattgcttctgataacgtactgggcggcaaaatcgctggtgattacatcgcgaagaaagcgggtgaaggtgccaaagttatcgagctgcaaggcattgctggtacatccgcagcccgtgaacgtggcgaaggcttccagcaggccgttgctgctcacaagtttaatgttcttgccagccagccagcagattttgatcgcattaaaggtttgaacgtaatgcagaacctgttgaccgctcatccggatgttcaggctgtattcgcgcagaatgatgaaatggcgctgggcgcgctgcgcgcactgcaaactgccggtaaatcggatgtgatggtcgtcggatttgacggtacaccggatggcgaaaaagcggtgaatgatggcaaactagcagcgactatcgctcagctacccgatcagattggcgcgaaaggcgtcgaaaccgcagataaagtgctgaaaggcgagaaagttcaggctaagtatccggttgatctgaaactggttgttaagcagtagttttaatcaggttgtatgacctgatggtgacataaatacgtcatcgacagatgaacgtgtaatataaagaaaagcagggcacgcgccaccctaacacggtggcgcattttatggacatcccgaatatgcaaaacgcaggcagcctcgttgttcttggcagcattaatgctgaccacattcttaatcttcaatcttttcctactccaggcgaaaccgtaaccggtaaccactatcaggttgcatttggcggcaaaggcgcgaatcaggctgtggctgctgggcgtagcggtgcgaatatcgcgtttattgcctgtacgggtgatgacagcattggtgagagcgttcgccagcagctcgccactgataacattgatattactccggtcagcgtgatcaaaggcgaatcaacaggtgtggcgctgatttttgttaatggcgaaggtgagaatgtcatcggtattcatgccggcgctaatgctgccctttccccggcgctggtggaagcgcaacgtgagcgtattgccaacgcgtcagcattattaatgcagctggaatcaccactcgaaagtgtgatggcagcggcgaaaatcgcccatcaaaataagactatcgttgcgcttaacccggctccggctcgcgaacttcctgacgaactgctggcgctggtggacattattacgccaaacgaaacggaagcagaaaagctcaccggtattcgtgttgaaaatgatgaagatgcagcgaaggcggcgcaggtactgcatgaaaaaggtatccgtactgtactgattactttaggaagtcgtggtgtatgggctagcgtgaatggtgaaggtcagcgcgttcctggattccgggtgcaggctgtcgataccattgctgccggagatacctttaacggtgcgttaatcacggcattgctggaagaaaaaccattgccagaggcgattcgttttgcccatgctgccgctgcgattgccgtaacacgtaaaggcgcacaaccttccgtaccgtggcgtgaagagatcgacgcatttttagacaggcagaggtgacgcttggctacaatgaaagatgttgcccgcctggcgggcgtttctacctcaacagtttctcacgttatcaataaagatcgcttcgtcagtgaagcgattaccgccaaagttgaagcggcgattaaagaactcaattacgcgccatcagctctggcgcgtagcctcaaactcaatcaaacacataccattggcatgttgatcactgccagtaccaatcctttctattcagaactggtgcgtggcgttgaacgcagctgcttcgaacgcggttatagtctcgtcctttgcaataccgaaggcgatgaacagcggatgaatcgcaatctggaaacgctgatgcaaaaacgcgttgatggcttgctgttactgtgcaccgaaacgcatcaaccttcgcgtgaaatcatgcaacgttatccgacagtgcctactgtgatgatggactgggctccgttcgatggcgacagcgatcttattcaggataactcgttgctgggcggagacttagcaacgcaatatctgatcgataaaggtcatacccgtatcgcctgtattaccggcccgctggataaaactccggcgcgcctgcggttggaaggttatcgggcggcgatgaaacgtgcgggtctcaacattcctgatggctatgaagtcactggtgattttgaatttaacggcgggtttgacgctatgcgccaactgctatcacatccgctgcgtcctcaggccgtctttaccggaaatgacgctatggctgttggcgtttaccaggcgttatatcaggcagagttacaggttccgcaggatatcgcggtgattggctatgacgatatcgaactggcaagctttatgacgccaccattaaccactatccaccaaccgaaagatgaactgggggagctggcgattgatgtactcatccatcggataacccagccgacccttcagcaacaacgattacaacttactccgattctgatggaacgcggttcggcttagatttacgctgtcttttgatcaaattattaccatcggttgttttcagaagcatgaacattgctgctgaagcaacagtaataatgcccattgtgataaacgtatagtggaattgttcgacagtcgttgtgccttccattccttcataaacgcgaaggacggccgcacttacagcaacgcctaaactaatcgacagttgctgcgtgaccgccagaacactgttaccgctgctggcattgtcatcggtcagatcggcaagtgtgatggtattcatcgcggtaaactgcgtcgacatagccatccctaatataaacaacggcaagatcagcatccatatagccattgctggtgattgcaaagagaactgagcgatcattagcccaataatcaccgtgatccccactaacgtatggcgatagcccagacgacgtaagacttgggtaaccatcgattttgcaataatggaacctaacgctgtcggtgccatcatacagccagcaataaacgcctgataaccaaatcctacctgtaacatcaatggcataaggaacggtacacagccggtccccagacgggttgcaatattgcctacgataccgatcgagaaagtgcgggttttaaataaatctaatgaaattaatgggtttggcgtgcgtcgtgcatggagaatatagagaagcagtaacccgatgctggtgacaattaccgtcaaggcaatccagctggcgacaatcttttccccgaatagctctattccgcttgagaagagaacaaggctgaggccaaacagcaaaaagccagtgatatcgaatctgcgtcgtgcggtggtgaaattgggcatatgtttgcgcgcgtaaagaaggcccgcaatacctatggggatattgattaaaaatatccagtgccaggttgcccaggtgaccagcacgccgccaagaacggggcctaaaattggccccaccagacccggcatggcgacaaaattcaatactggaagaagttcattacgaggataagcgcgcagtaaggccagccgagcaacaggcatcatcattgcgccgcctatcccctgaataacccggaagacaaccagctgtggtagcgaattagaaagtgcgcaggccagagaacccaatgtgaacagactcacggcaagggtaaaaatgcgacgcgtaccgaagcgatcggctagccatccgcttaccggaataagcatcgccaccgtcagcgtataactgatgatggctgattgcatcgcgagaggagaacgattaaggctatgagcgattgcgggtaaggcggtattaagaatagtggcatcaagtgcctgcatgaagaaggccatcgccgcgatccacggcaaacccgccatactgcgcttctttttatcgctcattcaatgtcctgttatcgggttatcacttatcaggtgagcgtagcagcgcctgacaagctttaaatgccgcgtcgccatcgctttggataatcgcatcgacaatcgcctgatgcagatccagctttatcactgtgtcgctggtaattgacgtgaagtaagtgtgataaaccgaatggaatagcgaggcgaatgaggtcaaaaacggattggcgctcatttcatagatatgctcatgccaggccatatcgacttcgatccagcgttcacggcgaaagttctcttttaatgccgccatttcggccattaacgtattgagatgcgctttctgttccgcggtgccaaccgttgctgccagtaggcaggcttgcggctccagacagatacgcataaccagaaagtgatcgatgacctgatgaaagttctcttctgtcatccaccaggtaagcaattcctgatcaagaaaattccagttcgattgtggcatgacccgagtaccaattcgcggtcgcggtaaaaccatcccttttgccgttaacgttttgaccgcttcgcgtaccgctgtacgactcactccaaattgctcgcccagctcaatctcaccgggcaaaatggtgccgggttcatattcaccttttaagatccgttgcgccagcttctcagccagaacatacgaaaggtttttctgtgcagctaactgttgtgcgcttaaaggcattacttatcttcctttttctttttattcctccttagtatgccaccaggaagtgtgattacggttgcaaaaacggcaaattgcttgttttatggcacattaacggggcttttgctgaaaaaatgcgcggtcagaaaattattttaaatttcctcttgtcaggccggaataactccctataatgcgccaccactgacacggaacaacggcaaacacgccgccgggtcagcggggttctcctgagaactccggcagagaaagcaaaaataaatgcttgactctgtagcgggaaagcgtattatgcacaccccgcgccgctgagaaaaagcaaagcggcactgctctttaacaatttatcagacaatctgtgtgggcactcgaagatacggattcttaacgtcgcaagacgaaaaatgaataccaagtctcaagagtgaacacgtaattcattacgaagtttaattctttgagcatcaaacttttaaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgcagtgctcacacagattgtctgataggaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgaaagttgttcgtgagtctctcaaattttcgcaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtatgtgtgttagtggaagcgtctggaaaggcgcgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgcgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggtcagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgtggacccgtgatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggagctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagatgttttggcggatgagagaagattttcagcctgatacagattaaatcagaacgcagaagcggtctgatgaaacagaatttgcctggcggccgtagcgcggtggtcccacctgaccccatgccgaactcagaagtgaaacgccgtagcgccgatggtagtgtggggtctccccatgcgagagtagggaactgccaggcatcaaattaagcagtaagccggtcataaaaccggtggttgtaaaagaattcggtggagcggtagttcagtcggttagaatacctgcctgtcacgcagggggtcgcgggttcgagtcccgtccgttccgccaccctaattaggggcgtagttcaattggtagagcaccggtctccaaaaccgggtgttgggagttcgagtctctccgcccctgccagaaatcatccttagcgaaagctaaggattttttttatctgaaataaccctctccgaagtaaatccttctaccggcatccttgccagccattcatattaatacacttcatccagcacgttaattttcaaaagatcgcgaatcaacgcatttttatcgctattttgcagccatatggcataaagcggccgtgaaagtgttgtgctatcgacaacggtatgcaggccgccttttttacgcgcccagctgacgggtagccaggtgcaaccattaagcatcgcaatctgttgctgtgccagttcagcagaactggttgtcagaatgggcacttcgtcagcaccgatcaaacctgcctcatgctgttgaaaatctggcccccactcaagtcgcagataattaagatctccctttagttttgaaggggcactggtataaagcgctaaagtgaaatatcccagcaactgactactaaattcgtccattttgggcgcttcagtggtaataagaagatcaagctggcgttcatgcagctgttttaccagagactgccgttgggcaattcgcgcttcgaactgtaagcctgtatgggcatcctgattttgatacaagcgtcccagccactgattaagcatacattcccacaacgaggcgctggcaccgatagaaaactcgttatgtcgtgaggtatgcgccacctccttacgggcggcctgccaggtgctcatgagcgtttctgcataaggcagtagtttttcaccggcagcggttaaacggatattgtttctgtggcgggtgaaaaggttcacacccagttgattttccagttgtctgattcgaaagctcactgctgactgggtcagatagagcgattcagccgctcgaccaaagtgacgcgttcggctaacttccaggaaagtttttaacaattccgtatccacagtgctctccgcaaaattatttgtcgttatgatttaaatgttttgttttacactctgtcaagcgtaactaatactccgcgccataactagctcggtcaaagaattaggagcgtgcaggatggcggaaagctttacgacgactaatcgatatttcgacaataaacattatccacgtggattctctcgtcatggtgatttcaccatcaaagaggcacaactgcttgagcgtcatggttatgccttcaatgagttggatcttggcaaacgcgagccggttaccgaggaagagaaactcttcgtagcagtatgccgtggcgaacgtgagccagtgacagaagcagaacgcgtgtggtccaagtatatgacgcgtattaagcgtccaaaacgttttcacaccctttccggcggtaaaccgcaggttgaaggtgctgaagactacaccgattctgacgattaataaaaagggcgaaatgccctttttttatgtcagtagtttctgcagatggatgagcaaacggtcaatcgctcgatagctaactgcctcctgcaaatgctgacgtgtgataatgtcagactgatcaatatcagcaatggttcgtgcaactttcaataaccgctgccaggcacgaatcgataaccccagatggatcagtgttccttccaaccacatcgcatcttcgctctcaagtttgcagaattggcgtatttccggactatccagccaggcattcagtttattctgccgcttaaattggcgctctctggcggccattacgcgttgtttaacggtggcgctgctttctcccggcactaccgttttactcaaaatgccggggggtggtaatgggatctccagtgagagatcgaagcggtcgagaaagggccccgagagccggttgagataacgtaatgtctgttctggcgtgcagcggttatggtttccctgataatgtccggtagggctgggattcatcgccgcaacaagctggaaacgggctggataggttatttttgctcgtgtgcgtgaaagatggatctgcccggattcaatcggctctcgcaaggcatccagtgtacgccgttcaaattcaggtagctcatcaagaaaaagcacgccgttatgcgccagcgaaatttcaccgggccctggaattgcgccaccgcctaccatcgcagttaacgatgcactgtgatgaggtgagcggaacgggcgctgccgccattgtttttgtactgattcagcatttaccagacttaatatcgcagcactctccagtgcctcttcattgcttaaatctggcaacaggccattaatacggctggcgagcattgttttacctgttcccggcggcccaatcagtaaaaggttgtgcccgccagcagcggtaatttccagtcctcgctttccttgttcctgaccgataacatcactgagatcatgttgtagcgcccgggatactgcatcagttggtttcgggcgttcgagagcgtgcttaccttccagaaacgcacagacagcttgcagatgatcggctatcaggcatccttcaccgttaattagccccacttcatcttcgttatctttcgcgacgataatttttctgcccgacttaatagcttcagttgcactggagattgcgccgggaacgccacgcagagcgcctgtaagcgccagttctccgactaattcatattcatctaacttattggctgtaagctgttctgaggccgccagcaacgcaatggcgataggtaaatcatatcgtcccccttcttttggcagatcagctggagccaggttgatggtgatttttttcgccggatattcatatccgctattgataatggcgctgcgcacgcgatcgcgagcttcttttaccgttgtttctggtaagcccaccatcgttaagccgggtagacctttactgatatgtacctcaacagtgatcgggggcgcatttactcccagggctgcgcgggtatgaacaattgacagtgacataagccctccttgagtcaccattatgtgcataagatatcgctgctgtagcccgctaattcgtgaattttagtggctgattcctgtttatttgtgcaagtgaagttgagttgttctggcggtggaatgatgctcgcaaaaatgcagcggacaaaggatgaactacgaggaagggaacaacattcatactgaaattgaatttttttcactcactattttatttttaaaaaacaacaatttatattgaaattattaaacgcatcataaaaatcggccaaaaaatatcttgtactatttacaaaacctatggtaactctttaggcattccttcgaacaagatgcaagaaaagacaaaatgacagcccttctacgagtgattagcctggtcgtgattagcgtggtggtgattattatcccaccgtgcggggctgcacttggacgaggaaaggcttagagatcaagccttaacgaactaagacccccgcaccgaaaggtccgggggttttttttgaccttaaaaacataaccgaggagcagacaatgaataacagcacaaaattctgtttctcaagattcaggacggggaactaactatgaatggcgcacagtgggtggtacatgcgttgcgggcacagggtgtgaacaccgttttcggttatccgggtggcgcaattatgccggtttacgatgcattgtatgacggcggcgtggagcacttgctatgccgacatgagcagggtgcggcaatggcggctatcggttatgctcgtgctaccggcaaaactggcgtatgtatcgccacgtctggtccgggcgcaaccaacctgataaccgggcttgcggacgcactgttagattccatccctgttgttgccatcaccggtcaagtgtccgcaccgtttatcggcactgacgcatttcaggaagtggatgtcctgggattgtcgttagcctgtaccaagcacagctttctggtgcagtcgctggaagagttgccgcgcatcatggctgaagcattcgacgttgcctgctcaggtcgtcctggtccggttctggtcgatatcccaaaagatatccagttagccagcggtgacctggaaccgtggttcaccaccgttgaaaacgaagtgactttcccacatgccgaagttgagcaagcgcgccagatgctggcaaaagcgcaaaaaccgatgctgtacgttggcggtggcgtgggtatggcgcaggcagttccggctttgcgtgaatttctcgctgccacaaaaatgcctgccacctgtacgctgaaagggctgggcgcagtagaagcagattatccgtactatctgggcatgctggggatgcacggcaccaaagcggcaaacttcgcggtgcaggagtgtgacctgctgatcgccgtgggcgcacgttttgatgaccgggtgaccggcaaactgaacaccttcgcgccacacgccagtgttatccatatggatatcgacccggcagaaatgaacaagctgcgtcaggcacatgtggcattacaaggtgatttaaatgctctgttaccagcattacagcagccgttaaatcaatgactggcagcaacactgcgcgcagctgcgtgatgaacattcctggcgttacgaccatcccggtgacgctatctacgcgccgttgttgttaaaacaactgtcggatcgtaaacctgcggattgcgtcgtgaccacagatgtggggcagcaccagatgtgggctgcgcagcacatcgcccacactcgcccggaaaatttcatcacctccagcggtttaggtaccatgggttttggtttaccggcggcggttggcgcacaagtcgcgcgaccgaacgataccgttgtctgtatctccggtgacggctctttcatgatgaatgtgcaagagctgggcaccgtaaaacgcaagcagttaccgttgaaaatcgtcttactcgataaccaacggttagggatggttcgacaatggcagcaactgttttttcaggaacgatacagcgaaaccacccttactgataaccccgatttcctcatgttagccagcgccttcggcatccatggccaacacatcacccggaaagaccaggttgaagcggcactcgacaccatgctgaacagtgatgggccatacctgcttcatgtctcaatcgacgaacttgagaacgtctggccgctggtgccgcctggcgccagtaattcagaaatgttggagaaattatcatgatgcaacatcaggtcaatgtatcggctcgcttcaatccagaaaccttagaacgtgttttacgcgtggtgcgtcatcgtggtttccacgtctgctcaatgaatatggccgccgccagcgatgcacaaaatataaatatcgaattgaccgttgccagcccacggtcggtcgacttactgtttagtcagttaaataaactggtggacgtcgcacacgttgccatctgccagagcacaaccacatcacaacaaatccgcgcctgagcgcaaaaggaatataaaaatgaccacgaagaaagctgattacatttggttcaatggggagatggttcgctgggaagacgcgaaggtgcatgtgatgtcgcacgcgctgcactatggcacttcggtttttgaaggcatccgttgctacgactcgcacaaaggaccggttgtattccgccatcgtgagcatatgcagcgtctgcatgactccgccaaaatctatcgcttcccggtttcgcagagcattgatgagctgatggaagcttgtcgtgacgtgatccgcaaaaacaatctcaccagcgcctatatccgtccgctgatcttcgtcggtgatgttggcatgggagtaaacccgccagcgggatactcaaccgacgtgattatcgctgctttcccgtggggagcgtatctgggcgcagaagcgctggagcaggggatcgatgcgatggtttcctcctggaaccgcgcagcaccaaacaccatcccgacggcggcaaaagccggtggtaactacctctcttccctgctggtgggtagcgaagcgcgccgccacggttatcaggaaggtatcgcgctggatgtgaacggttatatctctgaaggcgcaggcgaaaacctgtttgaagtgaaagatggtgtgctgttcaccccaccgttcacctcctccgcgctgccgggtattacccgtgatgccatcatcaaactggcgaaagagctgggaattgaagtacgtgagcaggtgctgtcgcgcgaatccctgtacctggcggatgaagtgtttatgtccggtacggcggcagaaatcacgccagtgcgcagcgtagacggtattcaggttggcgaaggccgttgtggcccggttaccaaacgcattcagcaagccttcttcggcctcttcactggcgaaaccgaagataaatggggctggttagatcaagttaatcaataaatacaaaaaatgggacggcacgcaccgtcccatttacgagacagacactgggagtaaataaagtatgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaataatggctgactcgcaacccctgtccggtgctccggaaggtgccgaatatttaagagcagtgctgcgcgcgccggtttacgaggcggcgcaggttacgccgctacaaaaaatggaaaaactgtcgtcgcgtcttgataacgtcattctggtgaagcgcgaagatcgccagccagtgcacagctttaagctgcgcggcgcatacgccatgatggcgggcctgacggaagaacagaaagcgcacggcgtgatcactgcttctgcgggtaaccacgcgcagggcgtcgcgttttcttctgcgcggttaggcgtgaaggccctgatcgttatgccaaccgccaccgccgacatcaaagtcgacgcggtgcgcggcttcggcggcgaagtgctgctccacggcgcgaactttgatgaagcgaaagccaaagcgatcgaactgtcacagcagcaggggttcacctgggtgccgccgttcgaccatccgatggtgattgccgggcaaggcacgctggcgctggaactgctccagcaggacgcccatctcgaccgcgtatttgtgccagtcggcggcggcggtctggctgctggcgtggcggtgctgatcaaacaactgatgccgcaaatcaaagtgatcgccgtagaagcggaagactccgcctgcctgaaagcagcgctggatgcgggtcatccggttgatctgccgcgcgtagggctatttgctgaaggcgtagcggtaaaacgcatcggtgacgaaaccttccgtttatgccaggagtatctcgacgacatcatcaccgtcgatagcgatgcgatctgtgcggcgatgaaggatttattcgaagatgtgcgcgcggtggcggaaccctctggcgcgctggcgctggcgggaatgaaaaaatatatcgccctgcacaacattcgcggcgaacggctggcgcatattctttccggtgccaacgtgaacttccacggcctgcgctacgtctcagaacgctgcgaactgggcgaacagcgtgaagcgttgttggcggtgaccattccggaagaaaaaggcagcttcctcaaattctgccaactgcttggcgggcgttcggtcaccgagttcaactaccgttttgccgatgccaaaaacgcctgcatctttgtcggtgtgcgcctgagccgcggcctcgaagagcgcaaagaaattttgcagatgctcaacgacggcggctacagcgtggttgatctctccgacgacgaaatggcgaagctacacgtgcgctatatggtcggcggacgtccatcgcatccgttgcaggaacgcctctacagcttcgaattcccggaatcaccgggcgcgctgctgcgcttcctcaacacgctgggtacgtactggaacatttctttgttccactatcgcagccatggcaccgactacgggcgcgtactggcggcgttcgaacttggcgaccatgaaccggatttcgaaacccggctgaatgagctgggctacgattgccacgacgaaaccaataacccggcgttcaggttctttttggcgggttagggaaaaatgcctgatagcgcttcgcttatcaggcctacccgcgcgacaacgtcatttgtggttcggcaaaatcttccagaatgcctcaattagcggctcatgtagccgctttttctgcgcacacacgcccagctcaaacggcgttttctcatcgctgcgctctaaaatcatcacgcggttacgcaccggttcggggctgttttccagcaccacttccggcaacaatgccacgccacagccgagtgccaccatcgataccatcgcttcatgcccgccaaccgtggcgtaaatcatcgggttactgattttattgcgtcgaaaccacagttcaatgcggcggcgtaccggcccctgatcggccataataaacggcaccgttgaccagtccggcttctctaccgacacctgattacgcaccgggcagggcagcgcgggggcaatcagcactactgccagattctccagcatcgaaaacgccactgcgccgggcaaggtttccggtttacccgcaatcgccagatccgcttcaccagtgaccaccttttccatcgcatctgccgcatcaccagtagtaagtttaatctccaccgacgggtgttccgcgcggaagcgatccagaatcggcggcagatggctgtaggcagcggtcaccgagcagaagatatgtaattcgccagagagcgacggcccttgctgatcgatggtgtggcgcaactgctgatactgcaacagcgtttgctgggcgaaaacgcgcagctcttcgcccgcttcagtcagcgtcaccgtgcggttatcgcgcacaaacagcggctgaccgagatcttcttccaggcgctgaatctgccgtgagagcgtggatgggctaacgtgcatcgcccgcgcgctgcggccaaaatggcggctttccgccagatgcaggaaggttttcagatcgcgtaaatccacagggacagccctcgatgttgacgttgcaaaaattgcaatgtgacgttgtgaatatatcaatttccgcaataaatttcctgtcatatagtgaattcaatctcgcaaacgcgaaccgaacaataagaagcacaacatcacgaggaatcaccatggctaactacttcaatacactgaatctgcgccagcagctggcacagctgggcaaatgtcgctttatgggccgcgatgaattcgccgatggcgcgagctaccttcagggtaaaaaagtagtcatcgtcggctgtggcgcacagggtctgaaccagggcctgaacatgcgtgattctggtctcgatatctcctacgctctgcgtaaagaagcgattgccgagaagcgcgcgtcctggcgtaaagcgaccgaaaatggttttaaagtgggtacttacgaagaactgatcccacaggcggatctggtgattaacctgacgccggacaagcagcactctgatgtagtgcgcaccgtacagccactgatgaaagacggcgcggcgctgggctactcgcacggtttcaacatcgtcgaagtgggcgagcagatccgtaaagatatcaccgtagtgatggttgcgccgaaatgcccaggcaccgaagtgcgtgaagagtacaaacgtgggttcggcgtaccgacgctgattgccgttcacccggaaaacgatccgaaaggcgaaggcatggcgattgccaaagcctgggcggctgcaaccggtggtcaccgtgcgggtgtgctggaatcgtccttcgttgcggaagtgaaatctgacctgatgggcgagcaaaccatcctgtgcggtatgttgcaggctggctctctgctgtgcttcgacaagctggtggaagaaggtaccgatccagcatacgcagaaaaactgattcagttcggttgggaaaccatcaccgaagcactgaaacagggcggcatcaccctgatgatggaccgtctctctaacccggcgaaactgcgtgcttatgcgctttctgaacagctgaaagagatcatggcacccctgttccagaaacatatggacgacatcatctccggcgaattctcttccggtatgatggcggactgggccaacgatgataagaaactgctgacctggcgtgaagagaccggcaaaaccgcgtttgaaaccgcgccgcagtatgaaggcaaaatcggcgagcaggagtacttcgataaaggcgtactgatgattgcgatggtgaaagcgggcgttgaactggcgttcgaaaccatggtcgattccggcatcattgaagagtctgcatattatgaatcactgcacgagctgccgctgattgccaacaccatcgcccgtaagcgtctgtacgaaatgaacgtggttatctctgataccgctgagtacggtaactatctgttctcttacgcttgtgtgccgttgctgaaaccgtttatggcagagctgcaaccgggcgacctgggtaaagctattccggaaggcgcggtagataacgggcaactgcgtgatgtgaacgaagcgattcgcagccatgcgattgagcaggtaggtaagaaactgcgcggctatatgacagatatgaaacgtattgctgttgcgggttaagtgcgcgctgatgccctcaccccgaccctctcccacagggagagggagaaaacactcaaggccttctcctggagaaggccttgctattagttgcggtacagcaccttaatgatgtgatatccgaactgggtgtgcagcgggccggtcggctccagtaccggacaagagaaaaccactttatcgaacgccggaaccatctgaccctggcggaattcacctaaatcaccgccgcgtttgcctgatgggcaaatggagtgtttcttcgccagcttgccgaaatcggccccgttcttaatctgctcgagaagatccagagccagtttctcttcttttacaaggatatgcagtgctgctgctgtttttgccatgatcgtgccttgagtgaataattgtcaggcggcgattttagcatgatccgcagatgctaacgtaattgtcagtcagggagtggctggtacatatatggcaaaagcccggaaaatccgggcctcgcaggtccctcaaggggagaaaacttagggcctctatgggctacaaagtcattatcggggatggttattttattgtcaatttatgagcgatatggcattgattgacttgatgaccgccctctgtatgtctgcaaccaactcatgtggcaaacattgattaagataccctctgtaagtccttgctctgtttaatctgtttcgactgacttgttgtaccaggtcggctttggcccaacgaatctgctgatcaaagaattgcaggtcattgataacattactggctatttcaacatgcattccacgttttaacttgtctggtcgcgagtggttgataatggaacgacgatgcatgcgttgccattaatttttccgttgagcacgacaactaacctgttttttatcatttcaggaggaatgcggccatcgtaatacgtcgtgctgaacggtccattttggctaacaggatagttaccaaagttgcattccagtatttcaccaaccttagggctgaaattaatcgccacgagtaaacctctccttagtaaactctgaaaaagtaataacacaacgttacgacccgatattttctaagtctaatggattcacgatgaactccgatttcggtcttctctctctgatttaaacatccgcagccaaccggttagcggcttacacgcggtcacattcaaatgcgattctgctacaatcctccccccgttcgaagattgagcaatacacctatgcgtctaaaccccggccaacaacaagctgtcgaattcgttaccggcccctgcctggtgctggcgggcgcgggttccggtaaaactcgtgttatcaccaataaaatcgcccatctgatccgcggttgcggttatcaggcgcggcacattgcggcggtgacctttactaataaagcagcgcgcgagatgaaagagcgtgtagggcagacgctggggcgcaaagaggcgcgtgggctgatgatctccactttccatacgttggggctggatatcatcaaacgcgagtatgcggcgcttgggatgaaagcgaacttctcgttgtttgacgataccgatcagcttgctttgcttaaagagttgaccgaggggctgattgaagatgacaaagttctcctgcaacaactgatttcgaccatctctaactggaagaatgatctcaaaacaccgtcccaggcggcagcaagtgcgattggcgagcgggaccgtatttttgcccattgttatgggctgtatgatgcacacctgaaagcctgtaacgttctcgacttcgatgatctgattttattgccgacgttgctgctgcaacgcaatgaagaagtccgcaagcgctggcagaacaaaattcgctatctgctggtggatgagtatcaggacaccaacaccagccagtatgagctggtgaaactgctggtgggcagccgcgcgcgctttaccgtggtgggtgacgatgaccagtcgatctactcctggcgcggtgcacgtccgcaaaacctggtgctgctgagtcaggattttccggcgctgaaggtgattaagcttgagcagaactatcgctcttccgggcgtattctgaaagcggcgaacatcctgatcgccaataacccgcacgtctttgaaaagcgtctgttctccgaactgggttatggcgcggagctaaaagtattaagcgcgaataacgaagaacatgaggctgagcgcgttactggcgagctgatcgcccatcacttcgtcaataaaacgcagtacaaagattacgccattctttatcgcggtaaccatcagtcgcgggtgtttgaaaaattcctgatgcaaaaccgcatcccgtacaaaatatctggtggtacgtcgtttttctctcgtcctgaaatcaaggacttgctggcttatctgcgcgtgctgactaacccggacgatgacagcgcatttctgcgtatcgttaacacgccgaagcgagagattggcccggctacgctgaaaaagctgggtgagtgggcgatgacgcgcaataaaagcatgtttaccgccagctttgatatgggcctgagtcagacgcttagcggacgtggttatgaagcattgacccgcttcactcactggttggcagaaatccagcgtctggcggagcgggagccgattgccgcggtgcgtgatctgatccatggcatggattatgaatcctggctgtacgaaacatcgcccagcccgaaagccgccgaaatgcgcatgaagaacgtcaaccaactgtttagctggatgacggagatgctggaaggcagtgaactggatgagccgatgacgctcacccaggtggtgacgcgctttactttgcgcgacatgatggagcgtggtgagagtgaagaagagctggatcaggtgcaactgatgactctccacgcgtcgaaagggctggagtttccttatgtctacatggtcggtatggaagaagggtttttgccgcaccagagcagcatcgatgaagataatatcgatgaggagcggcggctggcctatgtcggcattacccgcgcccagaaggaattgacctttacgctgtgtaaagaacgccgtcagtacggcgaactggtgcgcccggagccgagccgctttttgctggagctgccgcaggatgatctgatttgggaacaggagcgcaaagtggtcagcgccgaagaacggatgcagaaagggcaaagccatctggcgaatctgaaagcgatgatggcggcaaaacgagggaaataatcaaggccggaaaagatgcgtcagcatcgcatccggcacttactcattaatgcacttccagcggccagtggacatagctctgccactggctttcctgagcaataatctctttacccagcggatgttgggttagccaaccttgcggaagcgtcaaggtcaacagttcatggttagcctgtaatgtcatctctggcacgagatcgtcacggcgacggctggcaaaaatgatggccaggcgtagtaaacggcagagttgttctgcgacgcgcggcggtacggcattttgctgatgcagcgatgagagatcgaccggattagtctggttgagcagtagcgtcgccagcaattttttctgtgcgggggtaaaaccgggaagatccagattacgcaccagataagcagcgtgttgcggcgcttgtttgaagtcaacgctcaggccgatttcatgaagctgacaggcgctgatgagcaaatcgcggcttattgcttcaagatgccattcgttttccacctgatcgaagaagttagccgcaactttggctacgcgctgtgcctgatcaatatcgatcataaagcggcgttgaatattacgcagcgtacggctgcgaatatcctgctcgacggccagatgcaacatgccgtagaccaggccttcacgcagcgcaccgcccgccagggtcatacactgaatattcagttcggtaaaaatggcgatcaggatcgccagaccactcgggaacactaacgcacgttccagcgtcagcccgtcaatctccagttcctccagccgaccgcaatgaatggctcgctgtttcaattgctgcaacttttccagggtaatgcgttcatccatcccctgtgccatcatgatttcctgtaacgcctgcacggtgccggaagcaccaacgcacactttccagccgtgataccgtaattcatcggcaaccggacgtaacacttcgcgtgccgctttttctgcagcatcaaaattttcctgccccagattacgatcggcaaaatagcgttccagccaggtgacgcagcccatcgacaggctgaacaacgaggtggtttgtgcacccgtgccggttaccagttcagtactggctccgcctatatccaccaccaggcgctgatcggcaccaccagtggtgtgagcaacgccctgataaatcagacgtgcttcctcttcaccgctgatcacctgtaccggacaaccgagaatttcctgcgctttggcaataaaatcacccgcattgacggcaaggcgtaacgtcgccgtagcgacaacgcgaatttgcgagggaggaatatcttgcagacgttcagcaaacaggcgcaaacattgccaaccgcgctccattgcttcattggagagggcattttcgctattcaggccagcagccagacgcactttgcgttttattcgcgtcagcgtctggatgcttccagccacctcgcgcacaaccagcatatgaaaactattcgaaccgagatcaatggctgcatacagcgacgaggtggaacccatactcttcatccttcaatctgtctctgtgttggctgcattctttcacctgaatcacttactacagtaagctcatcgggattcattctcttgccatcttgatacagtttgaatgattttgagtatgacattttttatttaacctgaacgacgacgattacgcggagcgccagtacgacgcggaccattgcctgtgcgcgggcgcgtgaggcgcagcggttttggcagatcggtcatcaatgcgtccggattgtatttgcttaccggaattgagtgaccaatataggtctcaatagcaggcaaattcaatgcatactcttcacacgccaggctgatagagtgaccgcttgcgcctgcgcgacctgtacgaccaatacggtgaacgtaatcttcacagtcatcgggtaaatcgtagttaaagacgtgcgtcactgccggaatatgcaaaccacgcgcggcaacgtcggtggcaaccagaatatccagatcgccacgggtaaattcatcaagaatacgcagacgttttttctgcgcgacatcgcctgtcaataaaccgacacgatgaccatctgctgccaggtggccccagatctcttcacaacggtgtttggtgttggcgaaaataatcgctctgtctggccactcttcttcgatcagcgtttgcagcaaacgcattttttcttcgttagaagggtagaaaagctcttctttaatacggtggcccgttttctgttccggttccacttcaatatattcggcattgttcatctgctcgaacgccagttcacgtacccggtacgaaagcgtggcggagaacagcatgttgaggcgctggtttgcaggcggcatacggcggaacagccagcggatatctttaataaagcccagatcgtacatgcgatcggcttcgtccagtaccaccacctgaatggcaccgaggttaatgtggttctgcttggcgtagtcaattaaacgccccgtggtgccaatcagaatgtcaacgccgctttccagcactttcagctgtttgtcgtagccatcaccaccgtaagccagacccagcttcaggccagtagcttccgccagcggttctgcgtcggcatggatctgcacggcaagttcacgcgtcggtgccataattaaggcacgcggctgattcaccttgcgatcggcaatcgcaggatgagagagaagataatgaaacgttgacgtaagaaacgccatcgttttcccggtaccggtttgcgcctgcccggctacgtcacgacccgccagcgtcagcggaagggccagtgcctgaatgggcgtacagttatgaaacccttttttttcaagggcttctacaaccttcggatgcagggcgaagtcggaaaacttctgttctgttaaatgtgttttgctcatagtgtggtagaatatcagcttactattgctttacgaaagcgtatccggtgaaataaagtcaacctttagttggttaatgttacaccaacaacgaaaccaacacgccaggcttattcctgtggagttatatatgagcgataaaattattcacctgactgacgacagttttgacacggatgtactcaaagcggacggggcgatcctcgtcgatttctgggcagagtggtgcggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagggaatttcatgttcgggtgccccgtcgctaaaaactggacgcccggcgtgagtcatgctaacttagtgttgacttcgtattaaacataccttattaagtttgaatcttgtaatttccaacgcttcccgttttatcttaaatgcgaagtgaacagatttctggctcgtcactcaatccgtcttgtcgtttcagttctgcgtactctcctgtgaccaggcagcgaaaagacatgagtcgatgaccgtaaacaggcatggatgatcctgccataccattcacaacattaagttcgagatttaccccaagtttaagaactcacaccactatgaatcttaccgaattaaagaatacgccggtttctgagctgatcactctcggcgaaaatatggggctggaaaacctggctcgtatgcgtaagcaggacattatttttgccatcctgaagcagcacgcaaagagtggcgaagatatctttggtgatggcgtactggagatattgcaggatggatttggtttcctccgttccgcagacagctcctacctcgccggtcctgatgacatctacgtttcccctagccaaatccgccgtttcaacctccgcactggtgataccatctctggtaagattcgcccgccgaaagaaggtgaacgctattttgcgctgctgaaagttaacgaagttaacttcgacaaacctgaaaacgcccgcaacaaaatcctctttgagaacttaaccccgctgcacgcaaactctcgtctgcgtatggaacgtggtaacggttctactgaagatttaactgctcgcgtactggatctggcatcacctatcggtcgtggtcagcgtggtctgattgtggcaccgccgaaagccggtaaaaccatgctgctgcagaacattgctcagagcattgcttacaaccacccggattgtgtgctgatggttctgctgatcgacgaacgtccggaagaagtaaccgagatgcagcgtctggtaaaaggtgaagttgttgcttctacctttgacgaacccgcatctcgccacgttcaggttgcggaaatggtgatcgagaaggccaaacgcctggttgagcacaagaaagacgttatcattctgctcgactccatcactcgtctggcgcgcgcttacaacaccgttgttccggcgtcaggtaaagtgttgaccggtggtgtggatgccaacgccctgcatcgtccgaaacgcttctttggtgcggcgcgtaacgtggaagagggcggcagcctgaccattatcgcgacggcgcttatcgataccggttctaaaatggacgaagttatctacgaagagtttaaaggtacaggcaacatggaactgcacctctctcgtaagatcgctgaaaaacgcgtcttcccggctatcgactacaaccgttctggtacccgtaaagaagagctgctcacgactcaggaagaactgcagaaaatgtggatcctgcgcaaaatcattcacccgatgggcgaaatcgatgcaatggaattcctcattaataaactggcaatgaccaagaccaatgacgatttcttcgaaatgatgaaacgctcataaatttgtcttatgccaaaaacgccacgtgtttacgtggcgttttgcttttatatctgtaatcttaatgccgcgctggcgatgttaggaaaattcctggaatttgctggcatgttatgcaatttgcatatcaaatggttaatttttgcacaggactggtgggtttggaacggactttcccttctgaataaaggtcttcgtggttatacttctgctaataattttctctgagagcatgcattgtgaatttactgacagtgagtactgatctcatcagtatttttttattcacgacactgtttctgttttttgcccgtaaggtggcaaaaaaagtcggtttagtggataaaccaaacttccgcaaacgtcaccagggattgatacctctcgttggggggatttcggtttacgcagggatttgcttcacgttcggaattgtcgattactatattccgcatgcatctctctatctcgcttgtgccggtgtgcttgttttcattggcgcgctggatgaccgttttgatatcagcgtaaaaatccgtgccaccatacaggccgctgttggcattgttatgatggtgttcggcaagctttatctcagtagcctgggttatatctttggctcctgggagatggtgctcggaccgtttggttacttcctgacgctatttgccgtctgggcggccattaatgcgttcaacatggttgatggcattgatggcttgctgggcgggttgtcctgcgtctcgtttgcagcaatcggtatgattttgtggttcgacgggcaaaccagcctcgcaatctggtgctttgcgatgatcgccgccatcctgccatacatcatgcttaaccttggtatcctgggtcgccgctacaaagtctttatgggtgatgcgggcagtacgctgattggttttaccgttatctggatcctgctcgaaacgacccagggcaaaacccatcccatcagcccggttaccgctttgtggataatcgccattccgctaatggatatggtggcgattatgtaccgtcgcctgcgtaaaggcatgagcccattctctcctgaccgtcagcatattcaccatttgatcatgcgtgccgggtttacttcccgtcaggcgtttgtgctgattacccttgccgcagcactgctcgcttccattggcgtgctggcagaatattctcattttgtcccggagtgggtcatgctggtgctctttttgctagcattcttcctctatggatattgcattaagcgtgcctggaaagttgctcgctttattaagcgcgtaaaacgcagactgcgtagaaatcgtggtggcagccccaatttaaccaaataaatgaggatgtgatgacacaaccaatgcctgggaaaccggccgaagacgctgaaaatgaactggatattcgtgggttgtttcgtaccttgtgggctgggaagctatggattattggcatggggctggcgtttgcgttaatcgcgctggcgtatacgttttttgctcgtcaggagtggagctcgacggcgattaccgatcgtccaacggtgaatatgctggggggatattactcgcagcagcaatttttgcgtaacctggatgtccgttcaaacatggcttctgccgaccaaccatcggtcatggacgaagcctataaagagtttgttatgcaactggcctcgtgggatacccgcagagagttctggctgcaaaccgactattacaaacagcggatggtgggcaacagcaaagccgatgcggcgttgctggatgaaatgattaacaacatccagtttatccccggagactttacccgcgcggtcaatgacagcgtgaagcttattgccgaaaccgcgcctgacgctaataacctgttacgtcagtatgttgcttttgccagccagcgtgcagccagccatctgaatgatgagctgaaaggcgcatgggcggcgcgtaccatccagatgaaagctcaggtgaagcgtcaggaagaggtggcgaaagccatctacgaccgccggatgaacagcattgagcaggcgctgaaaattgctgagcagcataatatttcgcgcagtgcgacagatgtacctgccgaggaattacctgattcagaaatgttcctgcttgggcgtccaatgcttcaggctcgactggaaaatttacaggccgtcggtccggcctttgatctcgactatgatcagaatcgggccatgttaaacaccctgaatgttggtccaaccctggatccgcgttttcagacctatcgctatttgcgtacgccggaagaaccggtaaaacgcgatagcccacgtcgtgccttcctgatgattatgtggggcattgtcggggggctgatcggggctggtgtcgcattaacccgccgttgctcgaaatagcaacactgctgcggtgagcgcaaaggcgctcgccgcttattcgaagagaatcgatgtgaaagtactgactgtatttggtacgcgcccggaagccatcaagatggcgccgttggtgcatgcgttggcaaaagatcctttttttgaggctaaagtttgcgtcactgcgcagcatcgggagatgctcgatcaggtgctgaaactcttttccattgtacctgactacgatctcaacataatgcagccaggacagggcctgacagagataacctgtcggattctggaagggctaaaacctattcttgccgagttcaaaccagacgtcgtgctggttcacggcgatacgacgacgacgctggcaaccagcctggcggcgttttatcagcgtattcctgttggtcacgttgaggctggtctgcgcacgggcgatctctattcgccgtggccggaagaggctaaccgtacattgaccgggcatctggcgatgtatcacttctctccaaccgaaacttcccggcaaaacttgctgcgtgaaaacgttgcggatagccgaatcttcattaccggtaatacagtcattgatgcactgttatgggtgcgtgaccaggtgatgagcagcgacaagctgcgttcagaactggcggcaaattacccgtttatcgaccccgataaaaagatgattctggtgaccggtcacaggcgtgagagtttcggtcgtggctttgaagaaatctgccacgcgctggcagacatcgccaccacgcaccaggacatccagattgtctatccggtgcatctcaacccgaacgtcagagaaccggtcaatcgcattctggggcatgtgaaaaatgtcattctgatcgatccccaggagtatttaccgtttgtctggctgatgaaccacgcctggctgattttgaccgactcaggcggcattcaggaagaagcgccttcgctggggaaacctgtgctggtgatgcgcgataccactgagcgtccggaagcggtgacggcgggtacggtgcgtctggtaggcacggataagcagcgaattgtcgaggaagtgacgcgtcttttaaaagacgaaaacgaatatcaagctatgagccgcgcccataacccgtatggtgatggtcaggcatgctctcgcattctggaagcgttaaaaaataatcggatatcactatgagttttgcgaccatttctgttatcggactgggttatatcgggctgccaacggcagcagcgtttgcctcacggcaaaaacaggtaattggtgtcgatatcaaccaacatgcggttgataccatcaatcgtggcgaaatccatatcgtcgaacctgatttggcgagtgtagtaaaaactgccgtagaaggcggttttttacgagcgagcacgacgccagttgaagcggatgcctggctgattgctgtacccacgccgtttaagggcgatcatgagccagatatgacctacgttgaatcggctgctcgctccattgcgccagtgctgaaaaaaggcgcgctggtgatccttgaatccacctcgccggtggggtcaaccgagaagatggcagaatggttagcagagatgcgtccggatctcactttcccgcagcaggtgggcgagcaggcggacgtcaacattgcttactgcccggaacgcgtgttaccaggacaggtaatggtcgagctgattaaaaacgatcgcgtgattggtggtatgacgccggtttgttcggcccgcgccagcgaactgtacaaaattttcctcgaaggtgagtgtgtcgtcactaactcgcggacggcggaaatgtgtaagctcaccgaaaacagcttccgcgatgtgaatatcgcttttgctaatgaattgtcgctgatttgtgccgatcaggggattaacgtctgggaactgattcgcctggcgaatcgtcaccctcgcgttaatattcttcagcctggccctggcgtgggcggtcactgcattgctgttgatccgtggtttatcgtggcacagaacccccagcaggcgcggcttatccgtaccgcgcgcgaagtgaacgatcacaaaccgttctgggttatcgatcaggtgaaagcggcggtggctgattgcctggcggctaccgataaacgcgccagtgaactgaaaatcgcctgctttggtctggcgtttaaaccgaatattgatgacctgcgcgaaagcccggcgatggaaatcgctgaactgatcgcccagtggcatagcggcgaaactctggttgttgagcctaacatccaccagttgccgaaaaaactgaccgggctttgtactctggcgcagcttgacgaggcgctggcaacggcagacgtgctggtgatgctggtcgatcatagtcagttcaaagttatcaatggcgacaatgtccatcagcagtatgtcgtcgatgccaaaggagtctggcgctgatgagaaaaattctgataacaggtggtgccgggtttattggctcggcgctggtgcgttatatcatcaacgaaacgagcgacgcggtggtagtggtcgataagctgacctacgccggaaacctgatgtcgctggcaccggtcgcgcaaagcgagcgctttgcctttgagaaagttgatatctgcgatcgggcagaactggcacgcgtattcactgagcatcagccagactgtgtcatgcatctggcagccgaaagccatgttgaccgttctattgacggcccggcagcgtttattgaaaccaacattgtcgggacttatacattgcttgaagcggcgcgggcttactggaatgcgctgacggaagataaaaaatcagcgttccgttttcatcatatctccactgacgaagtatatggtgacctgcactcgacggatgatttcttcaccgaaaccacgccgtatgcgccgagcagcccttattccgcgtcaaaagccagcagcgaccatctggtgcgcgcctggctgcggacctatggtctgccgacgcttatcaccaactgctcgaataactacggcccttaccactttccggaaaaactgatcccgctgatgatcctcaacgcgctggcgggtaaatcgctgccggtatatggcaacgggcagcaaatccgtgactggctgtatgtggaagatcacgcccgcgcgctgtattgcgtggcgaccaccgggaaagtcggtgaaacctataatattggtggtcacaacgagcgtaagaatctcgatgttgtggaaaccatttgcgagctgctggaagaactggctccgaacaagccgcacggcgtggcgcactatcgtgacctgatcacctttgtcgctgaccgtccggggcatgatctgcgttatgccattgatgcttcgaaaattgcccgtgaacttggctggctgccgcaggaaacctttgaaagtggaatgcgtaaaacggttcagtggtatctggctaatgaaagctggtggaagcaggtgcaggacggcagctatcagggcgagcgtttaggtctgaaaggctaattttcagcggaggcaaacatgaaaggtattatcctggcgggcggttccggcacccgattgcatccgattacgcgcggcgtatcgaagcaactgttgccgatttacgataagccaatgatttactatccgctgtcggtgctgatgctggccggtatccgcgaaattctcatcatcactacgccggaagataaaggttatttccagcgcctgctgggcgatggtagtgagttcggtatccagctggaatatgccgaacagcccagcccggacggtctggcgcaggcctttatcatcggtgaaaccttccttaatggtgaaccttcttgtctggtgctgggcgataacatcttcttcggtcagggcttcagtccgaagctgcgtcatgttgcggcgcgcaccgaaggggcgacggtttttggctatcaggtgatggacccggaacgctttggcgtggtggagtttgacgacaatttccgcgctatctcgctggaagaaaagccaaaacagccgaagtcaaactgggcggtgaccgggctttatttctacgacagtaaagtcgtggagtacgcaaagcaggtgaagccgtcggagcgtggtgaactggagattacctccatcaaccagatgtacctcgaggcgggcaacctgaccgttgaactgctcgggcgcggatttgcctggctggataccggcactcacgacagcctgattgaagccagcacctttgtacagacggtggaaaaacgccagggctttaagattgcctgcctggaagagattgcctggcgtaacggctggctcgatgacgagggtgtgaagcgtgctgccagttcattagcgaaaactggctacggccaatatctgctggagttacttcgtgcccgtccgcgccagtattgagccactaacctgggaaaacgccttctttggtgttaacagcgccatcgtgcgcattacgtctgaagcaccgctcctgacgccagacgcgttagcgccgtggtcacgggtgcaggccaaaattgcggcatcaaatacgggtgaactggatgccctgcaacagctgggattctccctggtagaaggtgaagttgatttggcgctacccgtgaacaatgccagtgatagcggtgctgtagtggcacaagagaccgatattcccgcattacgtcagttagccagcgccgcatttgcgcaaagccgttttcgtgcgccgtggtatgcgcctgacgccagcagtcgcttttatgcacagtggattgaaaatgccgtgcgcggcacctttgatcatcaatgtctgattttacgtgcggcgtccggcgatattcgcggctatgtctctttacgggaactcaatgcgacagatgcgcgaattggcctgctggctggacgcggtgcaggtgctgagctgatgcaaacggcgctaaactgggcgtatgctcgcggtaaaacaactttgcgggtggcgacccaaatgggcaacaccgccgcgcttaaacgatacatacaaagtggtgcgaatgtagaaagcaccgcgtactggttatacaggtgatcacatgattccatttaacgcaccgccggtggtgggaaccgaactcgactatatgcagtcggcaatgggtagcggcaaactgtgtggcgatggcggttttacccgtcgctgccagcagtggctggagcaacgttttggcagcgccaaagtgttactgacgccgtcctgcaccgcttcgctggagatggcggcgctgctgctcgatatccagcctggcgatgaagtgatcatgccgagctacacctttgtctccaccgccaatgcctttgtgctgcgtggcgcaaaaatcgtttttgtggatgttcgcccggacaccatgaacatcgacgaaacgctgattgaagcggcgatcaccgacaaaacgcgcgttatcgtgccggtccattacgcgggtgtggcctgcgaaatggacaccattatggcgttggcgaaaaagcataatttgtttgtggtagaagatgccgctcagggcgtgatgtccacttacaaagggcgtgcactgggaaccattggtcatattggctgctttagcttccatgaaaccaaaaactacacggcgggcggtgaaggcggcgcgacgctgattaacgataaagcgttaatcgaacgagccgagatcatccgtgaaaagggcactaaccgcagccagttcttccgtggtcaggtcgataaatatacctggcgcgatattggctccagctatttgatgtccgatctgcaagctgcatacctgtgggcgcaactggaagcagcggatcgtatcaaccagcaacgtctggcgctgtggcaaaactactacgatgcgttagcgcctctggcgaaagccgggcgtatcgagctgccgtcgattcccgatggctgcgtgcagaacgcgcatatgttctacattaaactgcgggatattgatgaccggagcgcgttgattaactttctgaaagaagcggaaatcatggcggtgtttcattacattccgctgcacggttgccctgcgggggaacactttggtgagttccacggtgaagatcgctacaccaccaaagagagcgagcgcctgctgcgcctgccgctgttctacaacctgtcgcccgtcaatcagcgtacggtaattgcgactttgttgaactacttttcctgatatgtcgttggcaaaagcgtccttgtggacggcggccagtacactggtcaagattggtgccgggttactggtcggtaagttgctggcggtgtcatttggtccggcggggcttgggctggcggcaaatttccgccagttgattaccgtgctcggcgtgcttgccggggctggcatctttaacggtgtaaccaaatacgttgcccagtaccatgataatccgcaacagctgcgccgcgtggtcggcacttcatcagcgatggtacttggtttctctacgctgatggcgctggtttttgtgctggcagctgcgccaatcagccagggattgtttggtaataccgactatcaggggctggtgcgtttagtggcgctggtgcaaatggggatcgcctggggcaacctgttactggcgctgatgaaaggctttcgcgatgccgcaggtaatgcgttatcgctgattgtcggcagcttgattggcgttctcgcgtactacgtcagttaccgtttgggcggttatgaaggggcgttgctgggtctggcgctgattcccgcgctggtggtaattcctgccgccatcatgttgatcaaacgtggtgtcatcccgttaagctatctgaaacccagctgggataacggtctggcagggcagttgagcaaatttacgctcatggcgttgattacgtcggtgaccttgcctgttgcttacatcatgatgcgtaaactgctggcggcgcagtatagctgggatgaggtggggatctggcaaggggtgagcagtatttccgatgcctacctgcaatttattacggcatcgttcagcgtatatttgctgcccacgttgtcgcggctaacggaaaagcgcgatatcacccgggaagtggttaaatcgctgaaattcgtcttaccggcagtggcggcggcgagttttaccgtctggctgctgcgtgattttgctatctggctgctgttgtcgaataaatttaccgctatgcgcgatctctttgcctggcagttagtgggtgatgtgttaaaagtgggcgcttatgtctttggttatctggtgatcgccaaagcgtcactgcggttttatattctggcggaagtcagccagttcactttattgatggtatttgcccactggctaatccctgcgcatggtgcactgggcgcggcgcaggcatatatggcaacttatatcgtctatttttctctttgttgtggcgtgtttttactctggcgtaggcgggcatgactgtactgattcacgtactgggatcggatatccctcaccataaccgaaccgttttgcggtttttcaatgacgcgctggccgcgacgagcgagcacgcgcgcgagtttatggttgttggcaaggacgacggcttaagtgatagctgtccggcgctttctgtgcaatttttccctgggaaaaaatcgctggcggaagcggtcatcgcgaaagcaaaagctaaccgtcagcagcgttttttcttccacggtcagttcaatcccacactgtggctggctctgctgagtggtggcattaagcccagccagtttttctggcatatctggggggcagacctgtatgagctttccagtggcttgagatataagcttttttacccactacgtcgcctggcgcaaaagcgagtcggctgtgtatttgccacccgcggcgatttgagcttttttgccaaaacgcacccaaaggtgcggggcgaactgctgttcttcccgacgcggatggacccttcgctcaatacgatggcgaacgatcggcaacgtgaagggaaaatgaccattctggtggggaactccggcgaccgcagcaatgagcatattgctgccttgcgcgccgttcatcagcaatttggcgatacggtaaaagtggtggtgccgatgggatatccgcctaataacgaagcgtacattgaggaagttcgtcaggcggggctggagttattcagcgaagaaaatctacaaattctgagcgaaaaactggaatttgacgcctatctggcgctacttcgtcagtgcgatcttggttactttatttttgcccgccagcagggcattggtacgctgtgcttactgattcaggcgggcattccttgtgtgcttaaccgggaaaatccgttctggcaggatatgacggaacaacatttgccggtgctgtttactaccgacgatctcaacgaggatattgtgcgtgaagcgcagcgccagttggcgtcggtggataaaaacaccattgccttctttagccctaactatctacaaggctggcagcgggcgttggcgattgccgccagggaggtcgcatgagtctgctgcaattcagtggcctgtttgttgtctggctgctctgcacgctgtttattgccacgctgacctggtttgagtttcgccgtgtgcgctttaacttcaatgtcttcttttcattgctgtttttgctcacctttttcttcggcttcccgctgaccagcgtgctggtatttcgctttgatgttggtgtcgcgccgccagaaatcttgttgcaggcgttgctttctgcgggctgcttctacgcggtttactatgtcacctacaaaacccgcctacgcaaacgcgttgctgatgtaccgcgccgtccgctgtttaccatgaaccgcgtggagaccaatcttacgtgggtgatcctgatgggtatcgcgctggtaagcgtcggcatcttcttcatgcacaacggctttttgctgttccggcttaactcctacagtcagatcttttccagtgaagtctccggcgtggcgttaaaacgcttcttttactttttcatcccggcgatgctggtggtctactttctgcgccaggacagcaaagcgtggctgtttttcctcgtcagcacggtcgcctttggcttgctgacttatatgattgtcggcggcactcgcgccaatatcatcatcgcattcgctatcttcctgtttattggcattattcgcggctggatttcgttgtggatgctggcggcggcgggcgtgctggggattgttggcatgttctggctggcactaaaacgctatggaatgaatgtgagcggcgatgaagcgttctatacgtttctctatctcactcgcgacaccttctcgccgtgggagaatctggcgttgctgttgcagaactacgacaacatcgacttccagggcctggctccaattgtccgcgatttctatgtctttatcccttcctggctgtggccgggtcgcccgagtatggtgctgaactcagccaactactttacctgggaagtgctgaataaccactccggactggcgatctcgcctacgcttataggctcactggtggtgatgggcggcgcgttgttcatcccgctcggggcgatcgtggttggtctgatcatcaaatggttcgactggctgtatgagctgggcaaccgcgagcctaatcgctataaagctgcgatattgcacagtttctgctttggggcgatcttcaatatgatcgtgctggcgcgtgaagggctggattcgtttgtctcacgcgtggtcttttttatcgtggtcttcggcgcatgtctgatgatcgcaaaactgttgtactggctttttgaaagcgccggactcattcataaacgtacaaaatcatcgctccggacgcaggttgaaggataacaatgaataacaacaccacggcaccaacctatacgctgcgtggcttacagttgattggttggcgtgatatgcagcacgccctcgattatctgtttgctgacgggcagcttaagcagggaacgctggttgccattaatgctgaaaaaatgctgactattgaagataacgccgaggtcagggagttaattaacgctgccgaatttaaatatgcggatggcatcagcgttgtacgttcagtacgtaaaaagtacccgcaggcgcaggtttcccgcgttgccggtgccgatctctgggaagagctgatggcgcgcgcaggcaaagaagggacgccggtatttcttgtgggcggtaaacctgaagtgctggcgcaaactgaagctaaactgcgcaaccagtggaatgtgaatatcgttggcagtcaggatggttattttaaacccgagcagcgtcaggcgctgtttgaacgcattcatgccagcggtgcgcaaatcgtcaccgttgcgatgggatcgccaaagcaggagatcatcatgcgcgactgccgtctggtacatccagatgcgctgtatatgggcgttggcgggacttacgatgttttcaccggtcacgtaaaacgcgcaccgaaaatctggcaaacgctggggctggagtggctctaccgcctgctttcgcagccgagccgcattaagcgtcagcttcgtttgctgcgttatttacgctggcactacaccggcaacctatgattttcctctctttgtaaagcgacggagtggtcactccgtcgcctgtctgcttttttattacacaaagcattcaaatttttaatgctttatttgccatttctcctgaattacgaaaacatttgcaacactcgatgtacccataacgataaccggtaacaccggaaagcatgcaaacacaacacgaggatttatggcagataacaaaccagagctacagcgtgggctggaagctcgacatatcgaactcatcgccctggggggcaccattggcgtcggcctgtttatgggggccgccagtaccctgaaatgggccgggccatccgtattgttggcctatatcatcgccgggctgttcgtctttttcatcatgcgttcaatgggcgaaatgttgttcctcgaaccggttaccggttcgttcgccgtttatgcgcatcgttatatgagcccgttctttggctatctcaccgcctggtcttactggtttatgtggatggcggtggggatctctgaaatcaccgccattggcgtttatgtccagttctggttcccggagatggcgcagtggatacccgcattgatcgcagtggcgctggtggcgttggcgaatctggcggcggtgcggttgtacggcgaaatcgagttctggttcgcgatgatcaaagtcaccacgattatcgtgatgattgtcattggcctgggcgtgattttctttggctttggcaatggcgggcagtcgattggttttagcaatctcacagagcatggcggtttctttgcgggtggctggaaagggttcctgaccgctctgtgtattgtggtggcgtcctaccagggcgtggagctgattggcattactgccggtgaagcgaagaatccgcaggtgacgctgcgcagtgccgtaggcaaggtgctgtggcggatcctgattttctacgtaggcgcgattttcgttatcgtcaccatcttcccgtggaatgaaataggcagcaacggcagcccgttcgtactgacttttgccaaaatcggtattaccgcagcggcgggcattatcaactttgtggtgctgacggctgcgctctctggctgtaacagcggcatgtacagttgcggacgtatgctctacgcactggcgaaaaaccgtcagttaccggcggcaatggcgaaagtttcccgtcacggcgtaccggttgcgggtgtggcagtatctattgctattctgctaattggctcatgcctgaactacatcattcccaatccgcagcgtgtgtttgtctacgtctacagtgccagcgtgcttccggggatggtgccatggtttgtgatattgataagccagctgcgttttcggcgtgcacataaagcggcgattgccagccatccgttccgctcaatcctgttcccgtgggccaattacgtaacaatggcattcctgatttgcgttttgatcggcatgtactttaatgaagatacgcgtatgtcgctgtttgttggcatcatctttatgctggcggtgacggcgatttataaagtttttggccttaatcgccacgggaaagcgcataaactggaggaataagcagcaaaacgcacaaaccgtaaccaaacgcgcaatttatttaaaaagggactagacagaggggtgggaagtccgtattatccacccccgcaacggcgctaagcgcccgtagctcagctggatagagcgctgccctccggaggcagaggtctcaggttcgaatcctgtcgggcgcgccatttagtcccggcgcttgagctgcggtggtagtaataccgcgtaacaagatttgtagtggtggctatagctcagttggtagagccctggattgtgattccagttgtcgtgggttcgaatcccattagccaccccattattagaagttgtgacaatgcgaaggtggcggaattggtagacgcgctagcttcaggtgttagtgtccttacggacgtgggggttcaagtcccccccctcgcaccacgactttaaagaattgaactaaaaattcaaaaagcagtatttcggcgagtagcgcagcttggtagcgcaactggtttgggaccagtgggtcggaggttcgaatcctctctcgccgaccaattttgaaccccgcttcggcggggttttttgttttctgtgcatttcgtcaccctcccttcgcaataaacgcccgtaataactcattgccccacggtatgatttcgcccttaacgtattgaaggatgacttcaggcaaggagcgaccatgctgcaacaggttccaacgcgtgcttttcatgtgatggcgaaaccgagcggttccgattgtaatctgaactgtgactactgtttttatctcgaaaaacaatccctttaccgcgaaaagccagtcacgcatatggacgatgacacgctggaagcgtatgtccgtcactatatcgctgccagcgaaccgcaaaacgaagtggcttttacctggcagggcggcgaaccaacgctactcgggctggcgttttaccgccgtgccgtagcgctacaggcgaaatatggtgctggcaggaagataagtaacagcttccagactaacggcgtgctgctggatgacgaatggtgcgcgtttctcgcggagcatcattttcttgttggtttatcgctggatggcccgcctgagatccacaatcaatatcgcgtgactaaaggtggcagacccacgcataagctggtgatgcgtgccctgacgctcctgcaaaaacatcatgtcgactataacgtgctggtctgcgttaatcgcaccagcgcgcagcaaccgttgcaggtatatgattttttgtgcgatgcgggagtcgaattcatccagtttattccggtggtcgagcgcctggctgatgaaacaactgcccgcgatggacttaagttacatgcgcctggtgatattcagggtgagctaacggaatggtcggtgcgccccgaggagttcggtgagtttctggtggcgatattcgaccactggatcaaacgcgacgtcggcaagattttcgtgatgaatatcgaatgggcgtttgccaattttgtcggtgcgccgggtgcggtttgccatcatcagccaacctgtgggcgctcggtgattgttgagcacaacggcgacgtttacgcctgtgatcactatgtttatccgcaatatcggctggggaatatgcaccagcaaacaattgcagaaatgatcgattccccgcaacagcaggcgtttggtgaagataaatttaagcagttaccggcgcagtgtcgcagttgtaacgtgttaaaagcgtgctggggaggctgcccgaaacaccgcttcatgctcgatgccagcggcaaaccgggactgaattatttgtgtgccgggtatcagcgttatttccgccatctaccgccatatcttaaagcaatggctgatttgctggcgcacggtcgcccggccagcgacattatgcatgcgcatttgctggtggtgagtaagtagaaatcggcggccgcctgcggttgattgccggatgcggcgtaaacgccttatccggcctacatgatcgtgcaaattcaataaattgcagcgttctgtaggctggataagatgcgtcagcatcgcatccggcaaaggcagatctcagcgatagcgccggcttagtcagatttaatctgcgcgcgtggtggatattttttcaggatctccatatacgcgtgcatttcggtctgtagcggtacacccatcggaatatggcgcacgccgatggagtcgctttcctgcggatcggtgtagaggttaaacaccgacgatcccgccgtttgcattactgtgccggtgaatccaccctgatatccgctctgggtataagcgtaaggttgctgaatcaggacgtgatacttgaactcatccatacgcacagcagcgagtttaccgttgaggaagtagtgctcggccttacggttagactgaccatttgttcccaggaagaaggatgtctggtccacaccatcgataaaggtggttttcggcactaaattcgccactttcgctccaggatgccctgccagatccagcgcggtagggaagagatctgccagatcgacaataccgtcagatttacgcggttggatcatccctttccagtaaacgaaagtcggtacgcgaacgccgccttcccaggtcgaacctttcgcaccacggaacggggtgcgtccgtgcggcggtacttcggcttccggtccgttatcggaggtaaagacgatcagcgtgttatcaagctgaccgtttttctccagtgttttatacagattagcgaacacatcgttcatctccaccatgcagtcgccatacgaggtgcgtgccggagagctacccgcatatttcgcatttgggtagttatcgaagtggcagccacgagtgccgtagtagaggaagaatggtttatcgctcttcgccatcttgtcgaggaacttaacgccatagtccatccagcgttgatccagatcttccatatatttcggcgtaatgtcggcaatggcctgttgttcgccgccgcgcaccgcatgaacgtcatctttgctgaacggtaattgcttgatgtattcagaacggtccggactcagggccacttccggattgacgtgaacgtcgcgccattcggtgtacatatcagacaccgagttaaagccacggaaatcatcaaagccaacgttctgcggctgcgactctttgttttcccccatatgccattttccgatggcctgagtgacgtagccctgatcgtgcagcaactgcggcagcgtggttaacccttgcagcccgcccggttgcccgtacattggcggcatcagaatgccgtggtggatggagtattgtccggtgagaatggtggcgcgggttggggaagagcttggttgagaatacgccgaagttaaaatcagcccctggctggcaacggcgtcgatatctggtgtagggttacccaccgccacgccgccaccgttaaaaccgacgtccatccagcccacatcgtccagcaagaaaacaaccacattcggtttcttaccggtttttttctcaagttctgccagcttctgctgggtttctttatcctgcgccggatgctgcattactggcatcatattgtcggcaatagtggtcgccggtttaaccagatactggtttgggtgatcgtatccggcaaagcctttgcgtgcggtggcagttgacggggtatctgctgcgctggccatgagaggaagagcggcggcgacagcaacaacaagacgtttgggtgaaaacgaaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtaaggcaggtttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcccgattctctgtggcataataaacgagtagatgctcattccatctcttatgttcgccttagtgcctcataaactccggaatgacgcagagccgtttacggtgcttatcgtccactgacagatgtcgcttatgcctcatcagacaccatggacacaacgttgagtgaagcacccacttgttgtcatacagacctgttttaacgcctgctccgtaataagagcaggcgtttttttatgtatcaggaaggccccggaggtgcttgcctccgggtgagaaggaactactgtggcgggttattctgcaacgttaacatcaaaccgtcgcgacgcatagctgcagcttcttccggcttgtgcagtctgtccagcgcgtcggcaagccatgcgtaatcgtaggcgtccggacgttgtttcagcgctgcgcggaaggcgagcgatgcttcctgccattctccgtgcttcatcagtgactggcccagtgtgctccacaacagcgggcgatcgccgacgtttttgatttgctggcgcagcactttttccagctgttccggattgtttgttttcagtcgaggaatcggcagcagtaggcgatcgtcgtactggcgtttcaggccatcgatgataatttgctgggcagtatcatgatcgtcacattcaataagatgttccgccattgccacctgcaacgctacctgatgacgcgttttccggctttggtttttccaccagttacgcaaaccttcgctaccgttatcggcacgcgcctgatccatcaggccaatccatgcctgttgttccagcattgcacgatgttcttcatcaccaacatgggctttcgccattgatgggataatatccagcagcgaactccatgcacctgtgcggatatacgcctgttccgccagacgtaatacttccggatggcgtggcgtaacttccagcagcttatccacgccgtggcgtgcagcatggttttcattacgggccagttgcagacgtacgcgggtgatttctaccggaatggtgtcgttgccggccagctccgctgcgcgttccagatgttggttggcgcgtgcttcatcaccacgttgttgcgcggcttcggcagccagtagatagttcaccaccggttgttccgcgtgatcggcatttttcgccatcagcttttcaacttgctgataatcgccttccgccagtttcagcagcgcctgttcggtctgcttacgtgcacggcgacgcttacgtccgacaaaccacccacgggtgtgcgcgccagtgcggaagatccgccgcagtagccactcaatggcaaacagcactaccatcgccagaatcaatatgatcgccaggcccgtgacgctggtttcgatattgtagttgtcggtctggatcagcacataaccctgatggccggcaatcatcgggccaaccacgatccccgcaatcagcaacacaaagagcaataacacttttagcatggttattctccttgcggcgcggctgccggagtatcagcttgcggtgcaggtgcaggtttagcttccgttgtccccgctgccggttgtgccagcaggttacgcacgcgagtctgcatcagtttttccagcatcgcctggctttgcagggtttccggaagatccatcgagatattttgctggcttaactggtccacctcgtcgaggaacgctttggtggtggcatcatcagtatcgtagtaagcacgtacccaggtggagacgttctccagcgcctggcgataagtctcttcctggtgacgcggtacagcttgtgctgcgaccagcaggcgagagcgaatattttcgcgcagatagatatcctgatttggcgctaacagcggtacggcggtgtcatcacgacggcgaatcgtaatgaagttgtccataaagttctgccagcttttttgcagattgatacgccattcgctgatggaactggaaagctcttcaccgtctgaatccatcggcgaaccatcgctgtcattatcggccagacgcaggttatctacctgatttgaaagctgattaagcttaaggatgatgccgtcataatccacctgcgatactgcagaaaggctggcgatatcatcggtaattgcccgacgaacggtaatcagactcgggtcattcatatccgccaggctggcgtctgcacttttcagcaacgctgcagcggtcgtgacgtcctgatcgctccacagcttccgtccggcgagtttcaccagaaaatcggcctgagccagcagccaggttttagcatcgctgccggaaatggtggcgaccttttgttggacttcatccaactgttttgccagcgtttcttgctgacgattcgcctgcttaagttgtgcagcttgttgcttaataatgccttccagctcggctttttggctctcctgggctttttgcaatgccgtcagttggttagccagggcatcgctggtggcggtctgattgacggcctgttgtttaccccagccatacaaaccgatgcccgccgccagagcaatagcgatagccaccgcgctgagaatcaatgcggtattgttcttactctttttttctgttgcgacaggttgtgacgtggtgtccacggcctccctggtctcttcaaccacggcggaggttttttcttgttccgtcattatggcttcctgttatgagagttattgtaatgcccgtaaaagcgcatcgttgtcagcgttatcggcgaccttaatgtcttgccagcccagttcccgggcgagtttcgccaaacgctcactgacgaccaatagtcgacagtgtagtaaccagtgctcacgataccattgtgggatcagcgaccagagttgctgcaacatttcaccgctggtaacaacgaccatcgtcacctcgcgggcttgccagcgcatcgcttcttctgcaccatcgtaatggattgcgcatcgttgataacattcacaaaaagtgacctcagcaccgcgcgccgtcagggtatccccaattagctcacgaccaccattgccacgtaatatcagcgcacgtttgcccgcaatattttgtaattcaggtaattgtagcaagacttcgctgatttcccgatcctgcgggtagagaatcttctgtccacttacggtatgtagtgccagtgcggtggtgcgtccaatggcgaaataatcaggtagtcggggccatttacgatcttgctgatgcagctgtgattgggcaaaagcaaccgcgtgttgcgagagggcaaacaacagatcgctctcccccagcgctgccagttgatcagcaagttgcggtaattgttgacccggagaaaactcaatcagcggaaaatgccaggccacctgccccagtgtgcgcagacggctcactaactcttctccagcgggagacgggcgggtgacaaggatactcatgccggggcgtctccgttatagacttcagcgaggatctcgcgcgcgccgttattcagtagctcttctgccagcgaaatccccatttgttcggcatcttgcggcgcaccgcggcgttcaccgcgaataatctgcgaaccgtccggcgcgccgaccagcgcacgcagccagatttcgccatcaataagctcggcgtagctaccaattggcacctgacatccgccttcgagacgggtattcatggcgcgttctgcggtaacgcgcagtgcagtttcgtggtgattcagcgcggcaagcagctcgcgagtgcgtgaatcatcaaggcggcattcaatacccaccgcaccttgtcctaccgccggaagagaaatctcgggtggcaacgcggcgcgaatacgtgactccagacctaaacgttttagtccggctacggcaagaatgatggcatcgtattcgccgttatccagtttgctcaggcgagtgccgacgttgccgcgcagggagcggataatcagatccggacggcgttcagccagttggcactggcgacgtaaactggacgtcccgacgatactgcctgccggtaacgcatccagactgtcatagttattggacacaaaggcatcgcgaggatcttcacgctcacaaatagtgaccagtcccagaccttgcgggaattcaaccggcacatctttcattgagtgtacggcgatatcggcgcgattttcgaggagcgcgacttccagctcttttacaaataagccttttccgcctactttcgccagcggcgtatcaagaatcacatcgccgcgcgtcaccatcggtaccagttcaacgaccaggcccggatggctcgccatcaacttgtctttgacatagtgtgcctgccagagtgcaagtgggctttggcgtgtggcaattcttaaaacattgtctaacatgcttgttaccgtcattatcatccgtggtccatcctaacatccttgccagagtgatgtcagtgttgtggtgaaacgtagacgcctgcgcaaaccgtaaaatgaggtctggcagtggatcctgacaggcgtttcacgccgttgtaataaggaatttacagagaataaacggtgctacacttgtatgtagcgcatctttctttacggtcaatcagcaaggtgttaaattgatcacgttttagaccattttttcgtcgtgaaactaaaaaaaccaggcgcgaaaagtggtaacggttacctttgacatacgaaatatcccgaatgccgcgtgttaccgttgatgttggcggaatcacagtcatgacgggtagcaaatcaggcgatacgtcttgtacctctatattgagactctgaaacagagactggatgccataaatcaattgcgtgtggatcgcgcgcttgctgctatggggcctgcattccaacaggtctacagtctactgccgacattgttgcactatcaccatccgctaatgccgggttaccttgatggtaacgttcccaaaggcatttgcctttacacgcctgatgaaactcaacgccactacctgaacgagcttgaactgtatcgtggaatgtcagtacaggatccgccgaaaggtgagcttccaattactggtgtatacaccatgggcagcacctcgtccgtagggcaaagttgttcctctgacctggatatctgggtctgtcatcaatcctggctcgatagcgaagagcgccaattgctacaacgtaaatgtagcctgctggaaaactgggccgcctcgctgggtgtggaagtcagcttcttcctgattgatgaaaaccgcttccgtcataatgaaagcggcagcctggggggcgaagattgtggctccacccagcatatactgctgcttgacgaattttatcgtaccgccgtgcgtctcgccggtaagcgtattctgtggaatatggtgccgtgcgacgaagaagagcattacgacgactatgtgatgacgctttacgcgcagggcgtgctgacgccaaatgaatggctggatctcggtggcttaagctcgctttctgctgaagagtactttggtgccagcctttggcagctctacaagagtatcgattccccatacaaagcggtactgaaaacactgctgctggaagcctattcctgggaatacccgaacccacgtctgctggcgaaagatatcaaacagcgtttgcacgacggcgagattgtatcgtttggtctcgatccatactgcatgatgctggagcgtgttactgaatacctgacggcgattgaagattttacccgtctggatttagtacgtcgctgcttctatttaaaagtgtgcgaaaagctcagccgtgaacgcgcctgcgtaggctggcgtcgcgcagtgttgagccagttagtgagcgagtggggttgggacgaagctcgtctggcaatgctcgataaccgcgctaactggaagattgatcaggtgcgtgaggcgcacaacgagttgctcgacgcgatgatgcagagctaccgtaatctgatccgctttgcgcgtcgcaataaccttagcgtctccgccagtccgcaggatatcggcgtgctgacgcgtaagctgtatgccgcgtttgaagcattaccaggtaaagtgacgctggtaaacccgcagatttcacccgatctctcggaaccgaatctgacctttatttatgtgccgccgggccgggctaaccgttcaggttggtatctgtataaccgcgcgccaaatattgagtcgatcatcagccatcagccgctggaatataaccgttacctgaataaactggtggcgtgggcatggtttaacggcctgctgacctcgcgcacccgtttgtatattaaaggtaacggcattgtcgatttgcctaagttgcaggagatggtcgccgacgtgtcgcaccatttcccgctgcgcttacctgcaccgacaccgaaggcgctctacagcccgtgtgagatccgccatctggcgattatcgttaacctggaatatgacccgacagcggcgttccgcaatcaggtggtgcatttcgatttccgtaagctggatgtcttcagctttggcgagaatcaaaattgcctggtaggtagcgttgacctgctgtaccgcaactcgtggaacgaagtgcgtacgctgcacttcaacggcgagcaatcgatgatcgaagccctgaaaactattctcggcaaaatgcatcaggacgccgcaccgccagatagcgtggaagtcttctgttatagccagcatctgcgcggcttaattcgtactcgcgtgcagcaactggtttctgagtgtattgaattgcgtctttccagcacccgccaggaaaccgggcgtttcaaggcgctgcgcgtttctggtcaaacctgggggttgttcttcgaacgcctgaatgtatcggtacagaaactggaaaacgccatcgagttttatggcgcgatttcgcataacaaactgcacggcctgtcagtgcaggttgaaaccaatcacgtcaaattaccggcggtggtggacggctttgccagcgaagggatcatccagttctttttcgaagaaacgcaagacgagaatggctttaatatctacattctcgacgaaagcaaccgggttgaggtatatcaccactgcgaaggcagcaaagaggagctggtacgtgacgtcagtcgcttctactcgtcatcgcatgaccgttttacctacggctcaagcttcatcaacttcaacctgccgcagttctatcagattgtgaaggttgatggtcgtgaacaggtgattccgttccgcacaaaatctatcggtaacatgccgcctgccaatcaggatcacgatacgccgctattacagcaatatttttcgtgatgaacgtgccggaaagcgaggcttatccggcatgcaatcttagcggaaactgactgtttcacccgcctgctgcgtcgccgcctgttccagcaaatcccagaaggtttcgccgctgcgatcacaaatccactcatcgcctttcaggtcaaaatggtagccgccctgtttggttgccagccatacctggtgcagcggctcctggcggttgataatgattttgctgccattctcaaaggtaatggtcagtacgccgccgttgatttcgcagtcgatatcgctgtcgccatcccagtcgtccaggcgttcttcaatggtcagccagagttgatcagccaggcgatgaaattcactgtcgttcattgttgtatcctgtttttaagtgatggcggcagtatagcggcatggggtcagggcttcaaagtttgcacctctgcggctgcgttccggcacgattcatccgtcaccggaataatgatgtctctgtgtagcgaaagatttgtctcttcattagggcgcagttacaccacgtctttccctgtttctggtaaacattatgatcaggtttaccgagcgagcatcctcacgctgacggaactaaaaaagacaacaaacaaaccacattgcgatagtgcataaagccatcctggcgcgaggtgccgatcacgaaactaccagcaaaacataaatccccacgagtaagcgttatactcgcagcatttcctcacttttcagacttcataaagagtcgctaaacgcttgcttttacgtcttctcctgcgatgatagaaagcagaaagcgatgaactttacaggcaatccataatgaaaaacgtgtttaaggcactcactgtattacttactctcttcagcctgacgggctgcggtctgaaaggtccgctctatttcccgcctgcagataaaaacgcaccgccgccgaccaaaccggtagagacgcaaacgcaatccacggtgccggataaaaacgatcgcgccactggcgatggtccatcccaggtgaattactaaaagtcagtttctgtacccgcgtgattggagtaaatgatgcagttctcgaaaatgcatggccttggcaacgattttatggtcgtcgacgcggtaacgcagaatgtctttttttcaccggagctgattcgtcgcctggctgatcggcacctgggggtagggtttgaccaactgctggtggttgagccgccgtatgatcctgaactggattttcactatcgcattttcaatgctgatggcagtgaagtggcgcagtgcggcaacggtgcgcgctgctttgcccgttttgtgcgtctgaaaggactgaccaataagcgtgatatccgcgtcagcaccgccaacgggcggatggttctgaccgtcaccgatgatgatctggtccgcgtaaatatgggcgaacccaacttcgaaccttccgccgtgccgtttcgcgctaacaaagcggaaaagacctatattatgcgcgccgccgagcagacaatcttatgcggcgtggtgtcgatgggaaatccgcattgcgtgattcaggtcgatgatgtcgataccgcggcggtagaaacgcttggtcctgttctggaaagccacgagcgttttccggagcgcgccaatatcggttttatgcaagtggttaagcgcgagcatattcgtttacgcgtttatgagcgtggggcaggagaaacccaggcctgcggcagcggcgcgtgtgcggcggttgcagtagggattcagcaaggtttgctggccgaagaagtacgcgtggaactccccggcggtcgtcttgatatcgcctggaaaggtccgggtcacccgttatatatgactggcccggcggtacatgtctacgacggatttattcatctatgaagcaaccaggggaagaactgcaggaaacactcacggagcttgatgaccgggcggttgtcgattatctgattaaaaatcctgagttttttatccgtaatgcgcgcgcagtagaagcgatacgtgtgccgcatccggtacgcggcaccgtttcgttggtcgagtggcacatggcccgcgcacgtaatcatattcatgttctggaagagaacatggcgctgttgatggaacaggctatcgccaacgaaggcctgttttatcgcctactctacctgcagcgcagtctcaccgccgccagcagtctcgacgatatgctgatgcgctttcaccgctgggcgcgcgatctcggcctggcaggtgcgagtctgcgcctgtttccggatcgctggcgcttaggtgcgccgtcgaaccacactcatctggcattaagccgtcagtctttcgaaccgctgcgtattcagcgtttggggcaggaacagcactatcttgggccgcttaacggaccagagctgctggtggtgctaccggaagcgaaagcggtgggatcggtggcgatgtcgatgctgggaagcgatgctgatttgggtgtcgtgctgtttaccagtcgcgatgccagtcactatcaacaagggcaaggaacgcagttacttcatgaaattgcgctgatgttgccggagcttctggagcgttggattgaacgcgtatgaccgatttacacaccgatgtagaacgctacctacgttatctgagcgtggagcgccagcttagcccgataaccctgcttaactaccagcgtcagcttgaggcgatcatcaattttgccagcgaaaacggcctgcaaagctggcagcaatgtgatgtgacgatggtgcgcaattttgctgtacgcagtcgccgtaaagggctgggagcagcaagtctggcgttacggctttctgcgctacgtagcttttttgactggctggtcagccagaacgaactcaaagctaacccggcgaaaggtgtttcggcaccgaaagcgccgcgtcatctgccgaaaaacatcgacgtcgacgatatgaatcggctgctggatattgatatcaatgatcccctcgctgtacgcgaccgtgcaatgctggaagtgatgtacggcgcgggtctgcgtctttctgagctggtggggctggatattaaacacctcgacctggagtctggtgaagtgtgggttatggggaaaggcagcaaagagcgccgcctgccgattggtcgcaacgctgtggcgtggattgagcactggcttgatttgcgcgacctgtttggtagcgaagacgacgcgctttttctgtcgaaactgggcaagcgtatctccgcgcgtaatgtgcagaaacgctttgccgaatggggcataaaacaagggctgaataatcacgttcatccgcataaattacgtcactcgttcgccacgcatatgctggagtcgagcggcgatcttcgtggtgtgcaggagctgctgggtcatgccaacctctccaccacgcaaatctatactcatcttgattttcaacaccttgcctcggtgtacgatgcggcgcatccacgcgccaaacgggggaaataatgcgtttttaccggcctttggggcgcatctcggcgctcacctttgacctggatgataccctttacgataaccgtccggtgattttgcgcaccgagcgagaggcgcttacctttgtgcaaaattatcatccggcgctgcgcagcttccagaatgaagatctgcaacgcctgcgccaggcggtacgggaagcggaacccgagatttatcacgacgtgacgcgctggcgttttcgttcgattgaacaagcgatgctcgacgccgggctgagtgccgaagaagccagtgcaggcgcacacgcagcaatgatcaactttgccaaatggcgcagccgaatcgacgtcccgcagcaaactcacgacaccttaaaacagctggcgaagaaatggccgctggtggcgatcaccaacggtaacgcccagccggagctgtttggtttgggggattattttgagtttgtgctgcgcgctggcccgcacgggcgctcaaaaccgttcagcgatatgtactttttggctgcggaaaaactcaacgtgccgatcggcgagatcttacatgttggggacgatctcaccactgacgtgggtggggcaattcgcagcggaatgcaggcttgttggatcagaccggaaaatggcgatctgatgcaaacctgggacagccgtttactgccgcatctggaaatttcccggttggcatctctgacctcgctgatataatcagcaaatctgtatatatacccagctttttggcggagggcgttgcgcttctccgcccaacctatttttacgcggcggtgccaatggacgtttcttacctgctcgacagccttaatgacaaacagcgcgaagcggtggccgcgccacgcagcaaccttctggtgctggcgggcgcgggcagtggtaagacgcgcgtactggtgcatcgtatcgcctggttgatgagcgtggaaaactgctcgccatactcgattatggcggtgacgtttaccaacaaagcggcggcggagatgcgtcatcgtatcgggcaactgatgggcacgagccagggcggtatgtgggtcggcaccttccacgggctggcgcaccgtttgctgcgtgcgcaccatatggacgccaatctgccgcaggatttccagatcctcgacagtgaagaccagctacgcctgcttaagcgtctgatcaaagccatgaacctcgacgagaagcagtggccgccgcggcaggcaatgtggtacatcaacagccagaaagatgaaggcctgcgtccgcatcatattcaaagctacggtaatccggtggagcagacctggcagaaggtgtatcaggcgtatcaggaagcgtgtgaccgcgcgggcctggtggacttcgccgagctgctgctgcgcgctcacgagttgtggcttaacaagccgcatatcctgcaacactaccgcgaacgttttaccaatatcctggtggacgaattccaggataccaacaacattcagtacgcgtggatccgcctgctggcgggcgacaccggcaaagtgatgatcgtcggtgatgacgaccagtcaatctacggctggcgcggggcgcaggtggagaatattcagcgtttccttaatgatttccccggtgccgaaactattcgtctggagcaaaactaccgctctaccagcaatattctgagcgccgctaacgccctgattgaaaacaataacgggcgtctgggtaaaaaactgtggaccgatggcgcggacggtgagcctatttccctctattgcgcttttaacgaactcgatgaagcgcgttttgtggttaaccgcatcaaaacctggcaggacaacggcggagcgcttgccgagtgcgccattctctaccgcagcaacgcccagtcgcgggtgctcgaagaggcgttattgcaggccagtatgccgtaccgtatttacggcgggatgcgcttcttcgaacgccaggaaatcaaagatgcgctctcgtatctgcgcctgattgccaaccgcaacgacgacgcggcctttgagcgtgtggtgaatacgccaacgcggggtattggtgaccggacgctggacgtggtacgtcagacatcgcgcgatcgccagttaacactctggcaggcatgtcgtgagctgttgcaggaaaaagccctcgccgggcgagctgccagcgccttgcagcgatttatggaattaatcgacgccttagcgcaggaaactgccgatatgccgctgcatgtacagactgaccgggtaattaaagactccggcctgcgtaccatgtatgagcaggagaagggcgaaaaaggtcagacgcgtatcgaaaacttagaggaactggtgacggcaacgcgccagttcagctacaacgaagaagacgaagatttaatgccgctgcaggcgttcctctcccatgcggcactggaagcaggtgaagggcaggcggatacctggcaggatgcggtgcagttgatgacgctacactcggcgaaaggcctggagttcccgcaggtgtttatcgttggtatggaagagggcatgttcccaagccagatgtcgctggatgaaggcgggcgtctggaagaagaacgccgtctggcctacgttggcgtaacccgcgcgatgcagaaactgacgctgacctacgcggaaacccgccgtctgtatggtaaagaggtttaccatcgcccgtcgcgctttatcggcgagctgccggaagagtgtgtggaagaggtgcgcctgcgcgccacggtaagccgcccggtcagccatcagcggatgggtacgccgatggtcgagaacgacagcggctacaagctcggccagcgcgtacgccacgctaagtttggtgaaggcaccattgtcaatatggaaggcagcggtgagcatagccgtttgcaggtggcatttcagggccagggtattaaatggctggtggcggcatacgcccggctggagtcggtgtaacgttgccggatgcggtgctgcgcaccttatttggcctaaaaaatcattcagattcaataaattgcaacgtcatgtaggccggatagggcgtttacgccgcatccggcatctgcgccatcttcagtatctgacacaaaactatcgttttaacctttccgctcgacggaaatcatggtgacaaaaggatagcgttgccacgggattgccccgcctttcatatacatatgtgaaatcgtgccatcaagataaagcagctgctcaacgttcagtttcgctttggcataacaggcaaaatcataaaaatttgttgcctgctggctcaacaaaaacacggcgttcccatgtttattaatcccaacaccgttacgaattttgcttgaggcgacgttgggatgaatacgcggattaattacaccgttttccatcaacattggccctgactgcaccgcaaactgaatctctttactggttttgaaggcatccagacgaacgatgccgactttatctcccgcgacataaaacacgccgccaggacggataaagaaattcccttcacctgaagcgagatttaacgccaccttctgctgaccgttttcgatgtacaaaccgagcggcgcatagctttcatcatagatgccgccgttcatcgccatctgcacctgaccctgactattaatatccgccagcagagcatgtaacgttccccacgcttcgccattggctttttgccagtacattttcacccgctctgtttgaggattaacggtatacgcctgtacggtcagcgtcggatctgagagtgcgcaatcatcagcggcaacagcaaacaagggaagtaaggtgagggcgagaaaaatccgtttgagattcaaggtgatcattcctttaccaatgagtagctgatgcgccattataggtcctggatgtgggatttttttatcctgttagcgaccttgacgagtaccaaaaagcgcgaagttcaactattgttctgtggtgttctgttgcgtgttgacggcaaaattttgctggcgtaacatgcgcgcacgatcactctaagaggacattcgccttggacacacccagtagatactggctcactatcctgtcatccaggatcaactcctaaggctatccctttttgctgatagccttagcggttgtcagcgacctcaatttttcccgtcgcgctgagtcaggctgtttaatggtctgaaacccaatttgtttctgtgtgcccaccgaactgtccgatattttaagcattgggagtcccggtcatgctgagcgcatttcaactggaaaataaccgactgacccggctggaagtcgaagagtcacaaccccttgtaaatgcagtatggattgatcttgtcgaaccggacgacgacgagcgactgcgcgtacaatctgaacttggccagagcctggcaacccgcccggaactggaagacatcgaagcatcggcacgtttctttgaagacgacgacggcctgcatattcactccttcttcttctttgaagatgcggaagatcacgccggtaactccactgtggcatttaccatccgtgatggtcgtctgtttactctgcgtgagcgtgaactgcccgcttttcgtctgtatcgtatgcgtgcccgtagccagtcgatggtagacggtaacgcctacgagttgctgctggatctgttcgaaaccaaaatcgaacagttggcagatgaaattgaaaatatctatagcgacctggagcagttgagccgggtgattatggaagggcatcagggcgatgagtacgacgaggcgctctccactctggcggaactggaagatatcggctggaaagttcgcctgtgtctgatggatacccagcgcgcgctcaacttcctggtgcgtaaagcgcgtttaccgggtgggcaactggagcaggcgcgtgaaatcctgcgagatatcgaatccctgctgccgcataacgaatccctgttccagaaggtgaacttcctgatgcaggcggcaatgggttttatcaacatcgagcagaaccgcatcatcaaaatcttctcggtggtatccgtggtattcctgccgccgacgctcgttgcttccagctatggcatgaactttgagtttatgccagaactgaagtggagcttcggctaccctggcgcgattatctttatgatcctcgcgggcctggcaccgtatctgtactttaagcggaagaactggttgtaaaaaacgagagcggtggcttagtctggctaagccacctgttattcaaaggctccaggtatttaacccttttacctctttctcatagaaccatttgttcgtgttaacagcaacataggctgctacggcaattcccagaatgttaacgccaattagtgcaccaacaaatagagatagaataccaagtaatagaactataattgcttttttccataaccccaggacaaataaatatatccaggaacagaagaaagcaatgaaattcatttgaatagttaagcgttgtcttacttttaatgctttaaatgctgctttatattctggtgttgccccccagaatccaggaaaaccatgttgatcataaaaattaaatcggtatttccatttttcacttaatgaaccatcgttcatatattccttactcataaatactccataactattgttttgatgaatcagtaggtgcaagcattagcatactgaaagtggaaaaataacaaatcaaaaaaatcatcgaaccattgcctgaacaggcaaaatcttcggctatcattgtgatgatagagatgatatatactgctaatgtaccaaaaacataagtttttatatagatgaaaccactatcacggagtcgctggcaattcatgttgatgacgagataatggagtacgatggtagagactataacaagaaagcctgcttctccatcgttaaaaaagataataagaaaggcaaaaatgaaatttattaaaataaatgaaaatatataacgacgtctggaaatcttaccgttagatgttgggataaatatacgtaacataaattttacatccttgtatgagtctccggtcagcatggcaatatgcccactctcatgcaagagtcggcatattttttcagaatatatttattttttatttggacgttctacgctgcgtataaatcgcatccatcacaaaaattgccagcgccacccaaataaaggcgaaagtcaccatcttatcggcacccggtttttcaccataaaacgtcacagccagcaggaacatcagcgtcgggccaatgtactggaaaaagcctaacgttgagagacgcaagcgcgtggcagcggcggtaaaacacaacagcggtacggtagtgacaataccggcggcgatcagcagtaaattcagcgacatcgggttttgccccatatggctggttgagctgtcggcaatagcaaacaggtaaattgccgccacgggcagcagccacatggtttcgattaacatgccggtttgcgcttcaacggcaatcttcttgcgtaccagaccgtagaaggcaaaactaaatgccagtcccagcgcgataataggtagcgaaccaaaagtccacagctggactaacacgccacatatcgccagaatcaccgccagccattgcatccggcggaatcgctcgccgaggaaaatcatccccagcacaatgttcaccagcgggttaataaagtaaccaaggctcgcttccagcatatggtgattgttcaccgcccagataaacagtagccagttgccaccaatcagcacggcagagactgccagcataaaaattttctgtggcgtctgaatcagcgtttttaaataggaccactggcggcaaatgctcatcagcaccaccataaagaaaaacgaccagatcacgcgatgcgtcaggatttcatcggcgggcacgtagtaaatcaacttgaagtacgctggcgctataccccaaataaaataagcggcaagagcgagtaatacgccctgccgcgtttgttttgcatccatcgggaatactcatttttaattggtaacagcagtttacctgcttttatgtcttcaacctaccatataggtggcggtggcactggcaatataaagctgttcttcattgtgtaattcaacgcgggcgacggcgactttattgcctgcacgcaacaggctactagtagcagtaaaacgctcgcccctgcctgggcgcagataatcaacgcgaagatcaatggtccccatccgcgatagccgctggcgtagttcatcttcactgatggtttcgtggcgggttaaggtacttcccacgcacaccagaccggcggcgacatccagcgccgacgcaatgaccccgccgtgcaaaatgctttgcgcccagttgcccaccatcattggctgatttttaaaggccagctgtgcgaactctttttcgtaacgctccagttccatccccaatgcgcggttaaatggcatgtgataaacaaacatctcacccactaatttcagggcttgttcagcggtcagtacggcagacatatcatccttacacttcattggttaatgaaatgttgattttatgcttctttgttgttggtttctactttaggaagggataactaacggctatggagttaagtatgtaaaatagcccgcagaaaaatattcaccttatcaataattcgttacggagaacacgaccgatgcggactctgcagggctggttgttgccggtgtttatgttgcctatggcagtatatgcacaagaggcaacggtgaaagaggtgcatgacgcgccagcggtgcgtggcagtattatcgccaatatgctgcaggagcatgacaatccgttcacgctctatccttatgacaccaactacctcatttacacccaaaccagcgatctgaataaagaagcgattgccagttacgactgggcggaaaatgcgcgtaaggatgaagtaaagtttcagttgagcctggcatttccgctgtggcgtgggattttaggcccgaactcggtgttgggtgcgtcttatacgcaaaaatcctggtggcaactgtccaatagcgaagagtcttcaccgtttcgtgaaaccaactacgaaccgcaattgttcctcggttttgccaccgattaccgttttgcaggttggacgctgcgcgatgtggagatggggtataaccacgactctaacgggcgttccgacccgacctcccgcagctggaaccgcctttatactcgcctgatggcagaaaacggtaactggctggtagaagtgaagccgtggtatgtggtgggtaatactgacgataacccggatatcaccaaatatatgggttactaccagcttaaaatcggctatcacctcggtgatgcggtgctcagtgcgaaaggacagtacaactggaacaccggctacggcggcgcggagttaggcttaagttacccgatcaccaaacatgtgcgcctttatactcaggtttacagcggctatggcgaatcgctcatcgactataacttcaaccagacccgtgtcggtgtgggggttatgctaaacgatttgttttgatgaacggttgagtggttggcaaatctggaatccagcatccaggattaccctctcagagactaaaagcattgcagtttctcgcgcaggcgctgaaaatagcgcctgtttttatttcaggcaatcggggtgaatgtggcgcaggcggaagtgttgaatctggagtccggagctaaacaggttttacaagaaacctttggctaccaacagtttcgccccggccaggaagaaattatcgacactgtgctttccggccgcgattgcctcgtcgtcatgcccactggtggcggaaaatccctttgctatcaaatccctgccttattgctaaacggccttaccgtggttgtttcaccgctgatttcgttgatgaaagatcaggtggatcaactgcaagccaacggcgtggcggcggcgtgccttaactcgacgcaaacccgcgaacagcaacttgaagtgatgacaggctgccgcaccgggcaaattcgtctgctttatatcgccccggaacgcctgatgctggataactttcttgagcatctggcgcactggaatccggtgttattagccgttgatgaagcgcactgtatctcccaatggggccacgatttccgcccggaatatgccgcgctcggtcagttgcgccagcggttcccgacgctgccgtttatggcgctgaccgccacagccgacgacaccacgcgccaggatatcgtgcgcctgctggggctgaacgatccgctgattcaaatcagcagttttgaccgtccgaatattcgctacatgctgatggagaagttcaaaccgctcgatcagttgatgcgctacgtgcaggaacagcgcggtaagtcaggcattatctactgcaacagccgcgcgaaagtagaagacaccgctgcgcgcctgcaaagcaagggaattagcgcggcggcctatcatgccgggctggaaaataatgttcgcgccgatgtgcaggaaaaattccagcgcgatgacctgcaaattgtggtggcgacggtggcgttcggcatgggcatcaataaaccaaacgttcgcttcgtggtccactttgatattccgcgcaatatcgaatcctattatcaggaaaccggacgcgccgggcgtgatggcctgcccgcggaagcgatgctgttttacgatccggctgatatggcgtggctgcgccgttgtctggaagagaagccgcaggggcagttgcaggatatcgagcgccacaaactcaatgcgatgggcgcgtttgccgaagcgcaaacttgccgtcgtctggtattgctgaactattttggcgaagggcgtcaggagccgtgcgggaactgcgatatctgcctcgatccgccgaaacagtacgacggttcaaccgatgctcagattgccctttccaccattggtcgtgtgaatcagcggtttgggatgggttatgtggtggaagtgattcgtggtgctaataaccagcgtatccgcgactatggtcatgacaaactgaaagtctatggcatgggccgtgataaaagccatgaacattgggtgagcgtgatccgccagctgattcacctcggcctggtgacgcaaaatattgcccagcattctgccctacaactgacagaggccgcgcgcccggtgctgcgcggcgaatcctctttgcaacttgccgtgccgcgtatcgtggcgctcaaaccgaaagcgatgcagaaatcgttcggcggcaactatgatcgcaaactgttcgccaaattacgcaaactgcgtaaatcgatagccgatgaaagtaatgtcccgccgtacgtggtgtttaacgacgcaaccttgattgagatggctgaacagatgccgatcaccgccagcgaaatgctcagcgttaacggcgttgggatgcgcaagctggaacgctttggcaaaccgtttatggcgctgattcgtgcgcatgttgatggcgatgacgaagagtagtcagcagcataaaaaagtgccagtatgaagactccgtaaacgtttcccccgcgagtcaaatgtatgttgatgttatttctcaccgtcgccatggtgcacattgtggcgcttatgagccccggtcccgatttcttttttgtctctcagaccgctgtcagtcgttcccgtaaagaagcgatgatgggcgtgctgggcattacctgcggcgtaatggtttgggctgggattgcgctgcttggcctgcatttgattatcgaaaaaatggcctggctgcatacgctgattatggtgggcggtggcctgtatctctgctggatgggttaccagatgctacgtggtgcactgaaaaaagaggcggtttctgcacctgcgccacaggtcgagctggcgaaaagtgggcgcagtttcctgaaaggtttactgaccaatctcgctaatccgaaagcgattatctactttggctcggtgttctcattgtttgtcggtgataacgttggcactaccgcgcgctggggcatttttgcgctgatcattgtcgaaacgctggcgtggtttaccgtcgttgccagcctgtttgccctgccgcaaatgcgccgtggttatcaacgtctggcgaagtggattgatggttttgccggggcgttatttgccggatttggcattcatttgattatttcgcggtgatgccagacgcgtcttcagagtaagtcggataaggcgtttacgccgcatccgacattatttttcacgcatgcctcgccgatgctaacagcgctcccaccagcataaacaacgagccgaaaatcttattcagcgccttcatctgctttggtcctttaatccatagagcaatccgttgagcaagggtggcgtaaccgatcatcacaataatatcgaccacaatagtggtgacgccgagcacgatatactgcatcagttgcggctgttgcggcatgatgaattgcggaaatagcgccgccagaaacacaatacttttgggattggtgagattcacaaaaactgcgcgctggaacaaatgtcgacgcgattgagtagaggccagcgatttaaggtcaattgcaccagcggcgcgccactgctggattcccagccaaatcaagtaagccgcgcctgcccacttcaacacttcaaacgcaatcactgagcgggaaaatagcgtccccaaccccacgccaaccagcacaatatgaatcgccagtccggtctgaagcccagcaatagacgccaccgcgccgcgataaccgtggttgagcgaggtggtcatagtgttgattgcaccagagcctggcgacaggcttaaaatgatcgatgtcagcaggtaggcaaaccaccattctaaggtcatgatgaactcccggtgtgtctatttttgtgccacaatacgctactgtcgcagcgttgtgtcaggcacgctaaaaaaaacgattttacgtggtttaagaggcagattacccgatgtttcagcagcaaaaagactgggaaacaagagaaaacgcgtttgctgcttttaccatgggaccgctgactgatttctggcgtcagcgtgatgaagcagagtttactggtgtggatgacattccggtgcgctttgtccgttttcgcgcacagcaccatgaccgggtggtagtcatctgcccggggcgtattgagagctacgtaaaatatgcggaactggcctatgacctgttccatttggggtttgatgtcttaatcatcgaccatcgcgggcagggacgttccggtcgcctgttagccgatccgcatctcgggcatgttaatcgctttaatgattatgttgatgatctggcggcattctggcagcaggaggttcagcccggtccgtggcgtaaacgctatatactggcacattcgatgggcggtgcgatctccacattatttctgcaacgccatccaggtgtatgtgacgccattgcgctaactgcgccaatgtttgggatcgtgattcgtatgccgtcatttatggcacggcagatcctcaactgggccgaagcgcatccacgtttccgtgatggctatgcaataggcaccgggcgctggcgcgcgttgccgtttgctatcaacgtactgacccacagcagacagcgatatcgacgtaacttacgcttctatgctgatgacccaacgattcgcgtcggtgggccgacctaccattgggtacgcgaaagtattctggctggcgaacaggtgttagccggtgcgggtgatgacgccacgccaacgcttctcttgcaggctgaagaggaacgcgtggtggataaccgcatgcatgaccgtttttgtgaactccgcaccgccgcgggccatcctgtcgaaggaggacggccgttggtaattaaaggtgcttaccatgagatcctttttgaaaaggacgcaatgcgctcagtcgcgctccacgccatcgttgattttttcaacaggcataactcacccagcggaaaccgctctacagaggtttaaatttcttatgtaccaggttgttgcgtctgatttagatggcacgttactttctcccgaccatacgttatccccttacgccaaagaaactctgaagctgctcaccgcgcgcggcatcaactttgtgtttgcgaccggtcgtcaccacgttgatgtggggcaaattcgcgataatctggagattaagtcttacatgattacctccaatggtgcgcgcgttcacgatctggatggtaatctgatttttgctcataacctggatcgcgacattgccagcgatctgtttggcgtagtcaacgacaatccggacatcattactaacgtttatcgcgacgacgaatggtttatgaatcgccatcgcccggaagagatgcgcttttttaaagaagcggtgttccaatatgcgctgtatgagcctggattactggagccggaaggcgtcagcaaagtgttcttcacctgcgattcccatgaacaactgctgccgctggagcaggcgattaacgctcgttggggcgatcgcgtcaacgtcagtttctctaccttaacctgtctggaagtgatggcgggcggcgtttcaaaaggccatgcgctggaagcggtggcgaagaaactgggctacagcctgaaggattgtattgcgtttggtgacgggatgaacgacgccgaaatgctgtcgatggcggggaaaggctgcattatgggcagtgcgcaccagcgtctgaaagaccttcatcccgagctggaagtgattggtactaatgccgacgacgcggtgccgcattatctgcgtaaactctatttatcgtaatcgttctttatttggtcagttgtcaacctgatacttcgctacaatggatacccgttaatcaaagagttttccattgtggcgctacttatcatcaccacgattctgtgggccttctcctttagcttttatggcgagtaccttgcggggcacgtcgatagctattttgcggtgctggtgcgcgttggcctggcggcactcgtttttctgccgtttctgcgtacccgtggcaatagcctgaaaacggtcggcctgtatatgctggtgggcgcgatgcagcttggcgtgatgtatatgctgagtttccgcgcttatctctacctgacggtttccgagctgctgctgttcaccgtgctgacgccgctctacatcacgctgatttatgacatcatgagtaagcgccgtctgcgctggggctatgcctttagcgccttgctggcggtgattggtgccgggattattcgctatgatcaggtcaccgaccatttctggactggcttgctgctggtgcaactctccaatatcacttttgccattggcatggtgggttacaaacgcctgatggaaactcgcccgatgccacagcataacgcctttgcgtggttctatcttggcgcgtttctggtggcagtgattgcatggttcttgctgggaaatgcgcagaaaatgccgcaaaccacgctgcaatggggcattctggtgtttcttggcgtggtggcttccgggattggctactttatgtggaactacggcgcgacgcaggtggacgccggaacgctgggcattatgaataatatgcacgttccggcagggctgctggtaaacctggctatctggcaccaacagccgcactggccaacgtttattacaggcgcgctggtgatcctggcctcactgtgggtgcatcgtaagtgggtcgctccgcgctcttcacaaacggcagatgatcgcaggcgtgattgcgcgctgagcgaataaacgcttccgtaactggctgacgctgctcgccatcgcgcacggcggcgtacagtcggctccacaagccttcgcccagggttttggtcaccaccagaccctggcgctcaaaactctctactacccaatgcggtagcgcggcaatacccatccgcgcggcaaccatctgaatcaacaataaggtgttatcgacgcttttcagtgacgggctgacgcctgccggctgaagaaaatgccgccagacatccagtcgactacgctgcaccggataaattaatagcgtctcgctggcgagatcttccggtgtaattcgcgttttcgccgccagtggatggtcaggtgctaacaccagacgcacttcatagtcgaacatcggcgaataatgcaggccactgcgcggcagaatatcggacgtcattaccagatccagctctccctgttgcaaggcgggctgcgggtcaaatgtcacgcccgatttaaaatccatctctacctgcggccagttcttatggaaattttctaacgcgggtgtcagccactgaatacagctatggcactcaatggcaatgcgcagacgcgtctgctgcggttcattgcaggcttgcagggcctggctaatttgcggcagtacctggtttgccagttgcaacaggatttctccctgcggtgtaaagcgtagcggctggctcttacgcacaaatagccggaagccaaggcgttgttccagatcgctaaactggtgagacagggcggattgcgtctgatgcaacgtcgccgcagcggctgcgagcgagccgcagttccgcaacgcttgtagcgttttcaggtgttttacttcgatcatgaaagtccttcacttcggcatgaataatttgcgcttgaggaatatacagtaaccgccaattatggatgtgtaaacatctggacggctaaaatccttcgtcttttaaatttatggtgcgttggctgcgtttctccaccccggtcacttacttcagtaagctcccggggatgaataaacttgccgccttccctaaattcaaaatccataggatttacatataattagaggaagaaaaaatgacaatattgaatcacaccctcggtttccctcgcgttggcctgcgtcgcgagctgaaaaaagcgcaagaaagttattgggcggggaactccacgcgtgaagaactgctggcggtagggcgtgaattgcgtgctcgtcactgggatcaacaaaagcaagcgggtatcgacctgctgccggtgggcgattttgcctggtacgatcatgtactgaccaccagtctgctgctgggtaacgttccggcgcgtcatcagaacaaagatggttcggtagatatcgacaccctgttccgtattggtcgtggacgtgcgccgactggcgaacctgcggcggcagcggaaatgaccaaatggtttaacaccaactatcactacatggtgccggagttcgttaaaggccaacagttcaaactgacctggacgcagctgctggacgaagtggacgaggcgctggcgctgggccacaaggtgaaacctgtgctgctggggccggttacctggctgtggctggggaaagtgaaaggtgaacaatttgaccgcctgagcctgctgaacgacattctgccggtttatcagcaagtgctggcagaactggcgaaacgcggcatcgagtgggtacagattgatgaacccgcgctggtactggaactaccacaggcgtggctggacgcatacaaacccgcttacgacgcgctccagggacaggtgaaactgctgctgaccacctattttgaaggcgtaacgccaaatctcgacacgattactgcgctgcctgttcagggtctgcatgttgacctcgtacatggtaaagatgacgttgctgaactgcacaagcgcctgccttctgactggttgctgtctgcgggtctgatcaatggtcgtaacgtctggcgcgccgatcttaccgagaaatatgcgcaaattaaggacattgtcggcaaacgtgatttgtgggtggcatcttcctgctcgttgctgcacagccccatcgacctgagcgtggaaacgcgtcttgatgcagaagtgaaaagctggtttgccttcgccctacaaaaatgccatgaactggcactgctgcgcgatgcgctgaacagtggtgacacggcagctctggcagagtggagcgccccgattcaggcacgtcgtcactctacccgcgtacataatccggcggtagaaaagcgtctggcggcgatcaccgcccaggacagccagcgtgcgaatgtctatgaagtgcgtgctgaagcccagcgtgcgcgttttaaactgccagcgtggccgaccaccacgattggttccttcccgcaaaccacggaaattcgtaccctgcgtctggatttcaaaaagggcaatctcgacgccaacaactaccgcacgggcattgcggaacatatcaagcaggccattgttgagcaggaacgtttgggactggatgtgctggtacatggcgaggccgagcgtaatgacatggtggaatactttggcgagcacctcgacggatttgtctttacgcaaaacggttgggtacagagctacggttcccgctgcgtgaagccaccgattgtcattggtgacattagccgcccggcaccgattaccgtggagtgggcgaagtatgcgcaatcgctgaccgacaaaccggtgaaagggatgctgacggggccggtgaccatactctgctggtcgttcccgcgtgaagatgtcagccgtgaaaccatcgccaaacagattgcgctggcgctgcgtgatgaagtggccgatctggaagccgctggaattggcatcatccagattgacgaaccggcgctgcgcgaaggtttaccgctgcgtcgtagcgactgggatgcgtatctccagtggggcgtagaggccttccgtatcaacgccgccgtggcgaaagatgacacacaaatccacactcacatgtgttattgcgagttcaacgacatcatggattcgattgcggcgctggacgcagacgtcatcaccatcgaaacctcgcgttccgacatggagttgctggagtcgtttgaagagtttgattatccaaatgaaatcggtcctggcgtctatgacattcactcgccaaacgtaccgagcgtggaatggattgaagccttgctgaagaaagcggcaaaacgcattccggcagagcgcctgtgggtcaacccggactgtggcctgaaaacgcgcggctggccagaaacccgcgcggcactggcgaacatggtgcaggcggcgcagaacttgcgtcgggggtaaaatccaaaccgggtggtaataccacccggtcttttctcattacagcgacttcttcccaccatactgcttaaaccattccagcatacgctgccagccatcttctgcagatgcggcatgatagctcgggcgataatcagcgttgaatgcatgcccggcgtccgggtacacgataatctctgctttcgcattagcagcccgcagcgcctggcgcatggtttcaacgctctcctgcggaatgctgttatcctgaccaccatataagccgagaatcggcgcgttaagatcggttgcgatatcaacaggttgtttcggtgaattcagcgacttgtcgcccgtcagtttgccgtaccacgccactgcggcttttagctgtggattatgcgcggcatacagccaggtgatacgtccaccccagcagaatccggtgatcattaaacgatgaacatcgccgccgttgcgggaagcccaactggcgacatgatcgagatcggccagcacctgcgagtcaggcacttttgctaccagaccgctaagcaacgtggggatatcggcaaaatcattcggatcgccttcgcggaagtaaagttcaggtgcgatagccagatacccctccagcgccagacggcgacaaatgtcgcggatatgttcatgcacgccaaaaatttcctgcactacaatgaccactggcagtgggccatcgctttgctttggtctggcatggtaagcaggcatgttatccccttgtgaagggatagaggtgaagcccgccacaatcgcgtcgtccggggtctgaacgatggtcgaagcgagaggcgatgcagcaggtgcaaatccagattgttgtgttgttgccatggtattctccgtacccttataaaaatgttgcgcaatgttaactatagtcagcatgcaacaaatcacattgcctgaatcggctcatcttttatgcagtcctgcagaatgaagggtgatttatgtgatttgcatcacttttggtgggtaaatttatgcaacgcatttgcgtcatggtgatgagtatcacgaaaaaatgttaaacccttcggtaaagtgtctttttgcttcttctgactaaaccgattcacagaggagttgtatatgtccaagtctgatgtttttcatctcggcctcactaaaaacgatttacaaggggctacgcttgccatcgtccctggcgacccggatcgtgtggaaaagatcgccgcgctgatggataagccggttaagctggcatctcaccgcgaattcactacctggcgtgcagagctggatggtaaacctgttatcgtctgctctaccggtatcggcggcccgtctacctctattgctgttgaagagctggcacagctgggcattcgcaccttcctgcgtatcggtacaacgggcgctattcagccgcatattaatgtgggtgatgtcctggttaccacggcgtctgtccgtctggatggcgcgagcctgcacttcgcaccgctggaattcccggctgtcgctgatttcgaatgtacgactgcgctggttgaagctgcgaaatccattggcgcgacaactcacgttggcgtgacagcttcttctgataccttctacccaggtcaggaacgttacgatacttactctggtcgcgtagttcgtcactttaaaggttctatggaagagtggcaggcgatgggcgtaatgaactatgaaatggaatctgcaaccctgctgaccatgtgtgcaagtcagggcctgcgtgccggtatggtagcgggtgttatcgttaaccgcacccagcaagagatcccgaatgctgagacgatgaaacaaaccgaaagccatgcggtgaaaatcgtggtggaagcggcgcgtcgtctgctgtaattctcttctcctgtctgaaggccgacgcgttcggccttttgtatttttgcgtagcgcctcgcaggaaatgcctttccaactggacgtttgtacagcacaattctattttgtgcgggtaagttgttgcgtcaggaggcgttgtggatttctcaatcatggtttacgcagttattgcgttggtgggtgtggcaattggctggctgtttgccagttatcaacatgcgcagcaaaaagccgagcaattagctgaacgtgaagagatggtcgcggagttaagcgcggcaaaacaacaaattacccaaagcgagcactggcgtgcagagtgcgagttactcaataacgaagtgcgcagcctgcaaagtattaacacctctctggaggccgatctgcgtgaagtaaccacgcggatggaagccgcacagcaacatgctgacgataaaattcgccagatgattaacagcgagcagcgcctcagtgagcagtttgaaaacctcgccaaccgtatttttgagcacagcaatcgccgggttgatgagcaaaaccgtcagagtctgaacagcctgttgtcgccgctacgtgaacaactggacggtttccgccgtcaggttcaggacagcttcggtaaagaagcacaagaacgccataccctgacccacgaaattcgcaatctccagcaactcaacgcgcaaatggcccaggaagcgatcaacctgacgcgcgcgctgaaaggcgacaataaaacccagggcaactggggcgaggtagtattgacgcgggtgctggaggcttccggtctgcgtgaagggtatgaatatgaaacccaggtcagcatcgaaaatgacgcccgctcgcggatgcagccggatgtcatcgtgcgcctgccgcagggaaaagatgtggtgatcgacgccaaaatgacgctggtcgcctatgaacgctattttaacgccgaagacgactacacccgcgaaagcgcgctacaggaacatatcgcgtcggtgcgtaaccatatccgtttgctgggacgcaaagattatcaacagctgccggggctgcgaactctggattacgtgctgatgtttattcccgttgaacccgcttttttactggcgcttgaccgccagccggagctgatcaccgaagcgttgaaaaacaacatcatgctggttagcccgactacgctgctggtggcgctgcgcactatcgccaacctgtggcgttatgagcatcaaagccgcaacgcccagcaaatcgccgatcgtgccagcaagctgtacgacaagatgcgtttgttcatcgatgacatgtccgcgattggtcaaagtctcgacaaagcgcaggataattatcggcaggcaatgaaaaaactctcttcagggcgcggaaatgtgctggcgcaggcagaagcgtttcgcggtttaggagtagaaattaaacgcgagattaatccggatttggctgaacaggcggtgagccaggatgaagagtatcgacttcggtcggttccggagcagccgaatgatgaagcttatcaacgcgatgatgaatataatcagcagtcgcgctagcccattgggagtagttaagccgggtagaaatctagggcatcgacgcccaatctgttacacttctggaacaattttttgatgagcaggcattgagatggtggataagtcacaagaaacgacgcactttggttttcagaccgtcgcgaaggaacaaaaagcggatatggtcgcccacgttttccattccgtggcatcaaaatacgatgtcatgaatgatttgatgtcatttggtattcatcgtttgtggaagcgattcacgattgattgcagcggcgtacgccgtgggcagaccgtgctggatctggctggtggcaccggcgacctgacagcgaaattctcccgcctggtcggagaaactggcaaagtggtccttgctgatatcaatgaatccatgctcaaaatgggccgcgagaagctgcgtaatatcggtgtgattggcaacgttgagtatgttcaggcgaacgctgaggcgctgccgttcccggataacacctttgattgcatcaccatttcgtttggtctgcgtaacgtcaccgacaaagataaagcactgcgttcaatgtatcgcgtgctgaaacccggcggccgcctgctggtgcttgagttctcgaagccaattatcgagccgctgagcaaagcctatgatgcatactccttccatgtgctgccgcgtattggctcactggtcgcgaacgacgccgacagctaccgttatctggcagaatccatccgtatgcatcccgatcaggataccctgaaagccatgatgcaggatgccggattcgaaagtgtcgactactacaatctgacggcaggggttgtggcgctgcatcgtggttataagttctgacaggagaccggaaatgccttttaaacctttagtgacggcaggaattgaaagtctgctcaacaccttcctgtatcgctcacccgcgctgaaaacggcccgctcgcgtctgctgggtaaagtattgcgcgtggaggtaaaaggcttttcgacgtcattgattctggtgttcagcgaacgccaggttgatgtactgggcgaatgggcaggcgatgctgactgcaccgttatcgcctacgccagtgtgttgccgaaacttcgcgatcgccagcagcttaccgcactgattcgcagtggtgagctggaagtgcagggcgatattcaggtggtgcaaaacttcgttgcgctggcagatctggcagagttcgaccctgcggaactgctggccccttataccggtgatatcgccgctgaaggaatcagcaaagccatgcgcggaggcgcaaagttcctgcatcacggcattaagcgccagcaacgttatgtggcggaagccattactgaagagtggcgtatggcacccggtccgcttgaagtggcctggtttgcggaagagacggctgccgtcgagcgtgctgttgatgccctgaccaaacggctggaaaaactggaggctaaatgacgccaggtgaagtacggcgcctatatttcatcattcgcacttttttaagctacggacttgatgaactgatccccaaaatgcgtatcaccctgccgctacggctatggcgatactcattattctggatgccaaatcggcataaagacaaacttttaggtgagcgactacgactggccctgcaagaactggggccggtttggatcaagttcgggcaaatgttatcaacccgccgcgatctttttccaccgcatattgccgatcagctggcgttattgcaggacaaagttgctccgtttgatggcaagctggcgaagcagcagattgaagctgcaatgggcggcttgccggtagaagcgtggtttgacgattttgaaatcaagccgctggcttctgcttctatcgcccaggttcataccgcgcgattgaaatcgaatggtaaagaggtggtgattaaagtcatccgcccggatattttgccggttattaaagcggatctgaaacttatctaccgtctggctcgctgggtgccgcgtttgctgccggatggtcgccgtctgcgcccaaccgaagtggtgcgcgagtacgaaaagacattgattgatgaactgaatttgctgcgggaatctgccaacgccattcagcttcggcgcaattttgaagacagcccgatgctctacatcccggaagtttaccctgactattgtagtgaagggatgatggtgatggagcgcatttacggcattccggtgtctgatgttgcggcgctggagaaaaacggcactaacatgaaattgctggcggaacgcggcgtgcaggtgttcttcactcaggtctttcgcgacagctttttccatgccgatatgcaccctggcaacatcttcgtaagctatgaacacccggaaaacccgaaatatatcggcattgattgcgggattgttggctcgctaaacaaagaagataaacgctatctggcagaaaactttatcgccttctttaatcgcgactatcgcaaagtggcagagctacacgtcgattctggctgggtgccaccagataccaacgttgaagagttcgaatttgccattcgtacggtctgtgaacctatctttgagaaaccgctggccgaaatttcgtttggacatgtactgttaaatctgtttaatacggcgcgtcgcttcaatatggaagtgcagccgcaactggtgttactccagaaaaccctgctctacgtcgaaggggtaggacgccagctttatccgcaactcgatttatggaaaacggcgaagcctttcctggagtcgtggattaaagatcaggtcggtattcctgcgctggtgagagcatttaaagaaaaagcgccgttctgggtcgaaaaaatgccagaactgcctgaattggtttacgacagtttgcgccagggcaagtatttacagcacagtgttgataagattgcccgcgagcttcagtcaaatcatgtacgtcagggacaatcgcgttattttctcggaattggcgctacgttagtattaagtggcacattcttgttggtcagccgacctgaatgggggctgatgcccggctggttaatggcaggtggtctgatcgcctggtttgtcggttggcgcaaaacacgctgattttttcatcgctcaaggcgggccgtgtaacgtataatgcggctttgtttaatcatcatctaccacagaggaacatgtatgggtggtatcagtatttggcagttattgattattgccgtcatcgttgtactgctttttggcaccaaaaagctcggctccatcggttccgatcttggtgcgtcgatcaaaggctttaaaaaagcaatgagcgatgatgaaccaaagcaggataaaaccagtcaggatgctgattttactgcgaaaactatcgccgataagcaggcggatacgaatcaggaacaggctaaaacagaagacgcgaagcgccacgataaagagcaggtgtaatccgtgtttgatatcggttttagcgaactgctattggtgttcatcatcggcctcgtcgttctggggccgcaacgactgcctgtggcggtaaaaacggtagcgggctggattcgcgcgttgcgttcactggcgacaacggtgcagaacgaactgacccaggagttaaaactccaggagtttcaggacagtctgaaaaaggttgaaaaggcgagcctcactaacctgacgcccgaactgaaagcgtcgatggatgaactacgccaggccgcggagtcgatgaagcgttcctacgttgcaaacgatcctgaaaaggcgagcgatgaagcgcacaccatccataacccggtggtgaaagataatgaagctgcgcatgagggcgtaacgcctgccgctgcacaaacgcaggccagttcgccggaacagaagccagaaaccacgccagagccggtggtaaaacctgctgcggacgctgaaccgaaaaccgctgcaccttccccttcgtcgagtgataaaccgtaaacatgtctgtagaagatactcaaccgcttatcacgcatctgattgagctgcgtaagcgtctgctgaactgcattatcgcggtgatcgtgatattcctgtgtctggtctatttcgccaatgacatctatcacctggtatccgcgccattgatcaagcagttgccgcaaggttcaacgatgatcgccaccgacgtggcctcgccgttctttacgccgatcaagctgacctttatggtgtcgctgattctgtcagcgccggtgattctctatcaggtgtgggcatttatcgccccagcgctgtataagcatgaacgtcgcctggtggtgccgctgctggtttccagctctctgctgttttatatcggcatggcattcgcctactttgtggtctttccgctggcatttggcttccttgccaataccgcgccggaaggggtgcaggtatccaccgacatcgccagctatttaagcttcgttatggcgctgtttatggcgtttggtgtctcctttgaagtgccggtagcaattgtgctgctgtgctggatggggattacctcgccagaagacttacgcaaaaaacgcccgtatgtgctggttggtgcattcgttgtcgggatgttgctgacgccgccggatgtcttctcgcaaacgctgttggcgatcccgatgtactgtctgtttgaaatcggtgtcttcttctcacgcttttacgttggtaaagggcgaaatcgggaagaggaaaacgacgctgaagcagaaagcgaaaaaactgaagaataaattcaaccgcccgtcagggcggttgtcatatggagtacaggatgtttgatatcggcgttaatttgaccagttcgcaatttgcgaaagaccgtgatgatgttgtagcgtgcgcttttgacgcgggagttaatgggctactcatcaccggcactaacctgcgtgaaagccagcaggcgcaaaagctggcgcgtcagtattcgtcctgttggtcaacggcgggcgtacatcctcacgacagcagccagtggcaagctgcgactgaagaagcgattattgagctggccgcgcagccagaagtggtggcgattggtgaatgtggtctcgactttaaccgcaacttttcgacgccggaagagcaggaacgcgcttttgttgcccagctacgcattgccgcagatttaaacatgccggtatttatgcactgtcgcgatgcccacgagcggtttatgacattgctggagccgtggctggataaactgcctggtgcggttcttcattgctttaccggcacacgcgaagagatgcaggcgtgcgtggcgcatggaatttatatcggcattaccggttgggtttgcgatgaacgacgcggactggagctgcgggaacttttgccgttgattccggcggaaaaattactgatcgaaactgatgcgccgtatctgctccctcgcgatctcacgccaaagccatcatcccggcgcaacgagccagcccatctgccccatattttgcaacgtattgcgcactggcgtggagaagatgccgcatggctggctgccaccacggatgctaatgtcaaaacactgtttgggattgcgttttagagtttgcggaactcggtattcttcacactgtgcttaatctctttattaataagattaagcaatagcatggagcgagcctcaccatcgggttcggtgaaaatggcctgaaagccttcgaacgcgccttcggtaataatcaccttatcacccggataaggggttgccggatcgacaatgtctttcggtttatataccgatagctgatgaataaccgccgatgggactatcgctggcgacgcgccaaagcgcacgaagtggctgacaccgcgggtcgcgttgatagtcgtggtatgaatcacttctgggtcaaattccacaaacaggtagttggggaacaatggctcactgactgcagtacgttttccacgcacgattttttccagggtgatcatcggtgccaggcaattcacagcctgtctttcgaggtgttcctgggcacgttgaagttgcccgcgcttgcagtacagtaaataccaggattgcataatgactcttatccgtttaatcggggcgcaaggatagcaaaagctttacgctaagttaattatattccccggtttgcgttataccgtcagagttcacgctaatttaacaaatttacagcatcgcaaagatgaacgccgtataatgggcgcagattaagaggctacaatggacgccatgaaatataacgatttacgcgacttcttgacgctgcttgaacagcagggtgagctaaaacgtatcacgctcccggtggatccgcatctggaaatcactgaaattgctgaccgcactttgcgtgccggtgggcctgcgctgttgttcgaaaaccctaaaggctactcaatgccggtgctgtgcaacctgttcggtacgccaaagcgcgtggcgatgggcatggggcaggaagatgtttcggcgctgcgtgaagttggtaaattattggcgtttctgaaagagccggagccgccaaaaggtttccgcgacctgtttgataaactgccgcagtttaagcaagtattgaacatgccgacaaagcggctgcgtggtgcgccctgccaacaaaaaatcgtctctggcgatgacgtcgatctcaatcgcattcccattatgacctgctggccggaagatgccgcgccgctgattacctgggggctgacagtgacgcgcggcccacataaagagcggcagaatctgggcatttatcgccagcagctgattggtaaaaacaaactgattatgcgctggctgtcgcatcgcggcggcgcgctggattatcaggagtggtgtgcggcgcatccgggcgaacgtttcccggtttctgtggcgctgggtgccgatcccgccacgattctcggtgcagtcactcccgttccggatacgctttcagagtatgcgtttgccggattgctacgtggcaccaagaccgaagtggtgaagtgtatctccaatgatcttgaagtgcccgccagtgcggagattgtgctggaagggtatatcgaacaaggcgaaactgcgccggaagggccgtatggcgaccacaccggttactataatgaagtcgatagtttcccggtatttaccgtgacgcatattacccagcgtgaagatgcgatttaccattccacctataccgggcgtccgccagatgagcccgcggtgctgggtgtcgcactgaacgaagtgtttgtgccgattctgcaaaaacagttcccggaaattgtcgatttttacctgccgccggaaggctgctcttatcgcctggcggtagtgacaatcaaaaaacagtacgccggacacgcgaagcgcgtcatgatgggcgtctggtcgttcttacgccagtttatgtacactaaatttgtgatcgtttgcgatgatgacgttaacgcacgcgactggaacgatgtgatttgggcgattaccacccgtatggacccggcgcgggatactgttctggtagaaaatacgcctattgattatctggattttgcctcgcctgtctccgggctgggttcaaaaatggggctggatgccacgaataaatggccgggggaaacccagcgtgaatggggacgtcccatcaaaaaagatccagatgttgtcgcgcatattgacgccatctgggatgaactggctatttttaacaacggtaaaagcgcctgatgcgcgtttgttttgccctatttatcgatccgacagagaaagcgcatgacaaccttaagctgtaaagtgacctcggtagaagctatcacggataccgtatatcgtgtccgcatcgtgccagacgcggccttttcttttcgtgctggtcagtatttgatggtagtgatggatgagcgcgacaaacgtccgttctcaatggcttcgacgccggatgaaaaagggtttatcgagctgcatattggcgcttctgaaatcaacctttacgcgaaagcagtcatggaccgcatcctcaaagatcatcaaatcgtggtcgacattccccacggagaagcgtggctgcgcgatgatgaagagcgtccgatgattttgattgcgggcggcaccgggttctcttatgcccgctcgattttgctgacagcgttggcgcgtaacccaaaccgtgatatcaccatttactggggcgggcgtgaagagcagcatctgtatgatctctgcgagcttgaggcgctttcgttgaagcatcctggtctgcaagtggtgccggtggttgaacaaccggaagcgggctggcgtgggcgtactggcaccgtgttaacggcggtattgcaggatcacggtacgctggcagagcatgatatctatattgccggacgttttgagatggcgaaaattgcccgcgatctgttttgcagtgagcgtaatgcgcgggaagatcgcctgtttggcgatgcgtttgcatttatctgagatataaaaaaacccgcccctgacaggcgggaagaacggcaactaaactgttattcagtggcatttagatctatgacgtatctggcaaaccatgcccgatgcgacgctgtcgcgtcttatcgtgcctacaaatagtccgaaccgtaggccggataaggcgtttacgccgcatccggcaattggtgcatgatgcctgatgcgacgctgtcgcgtcttatcgtgcctacaaatagtccgaaccgtaggccggataaggcgtttacgccgcatccggcaattggtgcatgatgcctgatgcgacgctggcgcgtcttatcaggcctacattggtgccggatcggtagaccggataaggcgttcacgccgcatccggcaagtggttaaacccgctcaaacaccgtcgcaataccctgacccagaccgatacacatcgtcgccagaccaaactgaacgtctttgcgttccatcagattcagcagcgtggtgctgatacgcgcaccggaacaacccagcggatgacccagcgcgatcgcgccaccgttgaggttgatcttctcgtcaatctgctcaattagtcccagatctttaatacatggcaggatctgcgcggcaaaggcttcgttcatttcaaacacgccgatatcgctggcagaaagccccgcttttttcagcgccagtttcgaggccggaaccgggccgtaacccataatcgatgggtcacaaccaacgaccgccatcgaacgcacacgagcgcgcggcttaagacctaattcatgggcgcggctttcactcatcaccagcatggcagctgcgccatcggaaagtgcagaagatgtgcccgccgttaccataccgtttactggatcaaacgccggacgcagcgtggcgagggcttccacggtggtttccgggcgaatcacttcgtcgtaattaaactgcttcaggacgccgtcggcatcgtgaccaccggtcgggatgatttcatttttaaatgcggccgactgcgtggcggcccaggcgcgggcgtgtgaccgcgcggcaaaggcatcctgcatttcacggctgataccgtgcatacgcgccagcatttctgccgttaagcccatcatgcccgccgctttggcgacattgcggctcaggccggggtgaaaatcgacgccgtgactcatcggcacatggcccatatgctccacgccgccaaccagacatgcctgcgcatcgccagtcatgatcattcgtgctgcgtcatgcagtgcctgcatggatgaaccacacaagcgattaacggtaaccgccgggacagagtgtggtacttctgccagcagcgccgcgttacgggcgatattaaaaccctgctccagcgtctgctgcacacaaccccagtaaatatcgtcgagggccgccgcttccagcgccgggttacgcgccagcaggctacgcattaaatgagcggagagatcttctgcacgcacgttacgaaaagcaccgcccttcgaacggcccatcggggtgcgaattgcatcgacaatgacaacctgttccattgtgactccttaagccgttttcaggtcgccaaccggacgggctggctcaaccggaggatagtacggttcgttatgacgcgctttattacgcagaccttccggcacttcatacagcgggccgaggtgctgatattgctgtgccatatcgaggtattttgcgctaccgagggtgtccagccagcggaacgcgccgccgtggaacggagggaagcccaggccgtagaccagcgccatatccgcttccgccggagtggcgataatgccttcctccagacagcgcaccacttcgttgaccatcgggatcatcatgcgggcgataatctcttcttcgctgaaatcgcgcttcggctggctcacttctgccagcaggtcttcaacggcggcgtcttcttctttcttcggcttacctttgctgtcttctttataacgccagaaaccgaggccgttcttctgaccaaagcggttggcatcaaacagcgcgtcgatggcatcgcggtaatctttctgcatccgctgcgggaagcctgctgccatgacagcctgagcgtgatgcgcggtatcaatgcccacaacgtccagcagatatgccgggcccatcggccagccaaactgtttttccatcactttgtcgatcttgcggaaatccgcgccgtcgcgcagcagctggctgaaaccggcgaaatacgggaacagcacgcggttaacaaagaagccggggcagtcgttaaccacaatcggcgtcttgcccatcttgctcgcccaggcgacaactttcgcgatggtttcgtcggagcttttctcgccgcgaataatttctaccaacggcattcggtggaccgggttaaagaagtgcatcccgcagaagttttccgggcgttccagcgcgttggccagttcgctgataggaatggttgaagtgttagacgccagcacggtatcctggcgtactttttgttcggtttctgccagtacggcttttttcactttcgggttttcaacaaccgcttctaccacaatatccacgcggtcaaatccggcgtagtcgagcgttgggtggattgtggagatcacgccagccagtttcagaccatcgatcttgccgcgctcaagctgcttgttcagcagtttcgcggcttcggtcatgccgagggttaacgacttgtcgttgatatctttcatgacaaccggcacgcctttccacgcagactggtaagcgatgccgccgcccataatgcctgcacccagcaccgcggcctgtttcggggtttcaacgtctttggtgagtttcttcgctttgccttttacatattgatcgttaaggaaaatgccgaccagtgcgcgggcttcgttggtatgcgccagcgggacaaaacttttgttttccaggtttaaggcttcttcacgaccaaaacgggccgcagcttcaatggtttttactgcggtgatgggggccggataatgtttccccgctgtttgtgcgaccatccctttagcgatggtgaagctcatggtggcttcaatcttgctcagttttagtggttccagcttcggctgacgttttgctttccagtcgaggtcgccgttaatggcctggcgtaaaaccgcctttgcgccttcaaccagtttttctgctttgactacgccatccaccagaccgattttcagcgcctgatccgcgccgacatctttaccggcggcaatgatttccagcgcactgtcagcgcccagcatacgtggcatacgtacagaaccgccaaagccaggcatgatgcccagtttggtttccggcagaccgatgcgcagatccggcgtcgccagacgataatcggtcgccagcacgcattcgcagccaccgcccagcgcatagccattgacggcagcaatggtcggcaccggcagatcttccaggcgattaaacacgctattggcaaagtgcagccactgacttaactgttcttcaggaacgaggaacagggacaaaaattcggtgatatcagcaccgacgataaaggctgctttgttcgaacgcagcagcagcccttttagatctgattgctgttccagcacgccgatggcctcgccgaggctggcgacggtcgcagtgtcgagtttattaactgaacctggggcatcaaataccagttcggcaatgccatcttccagccagtcaaggtacagggtgtcgcctttgtaaagcatgtcagtctcctgaatccgcaaggtgatctggtcgtaccagatgagtcgaagtgtgtattttgtgttaaaaatatgcaaacaaaagattaaagaaatgccgatctgatcacgctcggcagaaatcacgctctggatgaacgatgtgctaagatgcggagacttaaggtcaaaaaaacagaagggtaaaaaatggaatcactggcctcgctctataaaaatcatatagctaccttacaagaacggactcgcgatgcgctggcgcgcttcaagctggatgcgttacttattcactccggcgagctgttcaatgtttttctcgacgatcatccctatccgtttaaagtgaacccgcaattcaaagcgtgggtgccggtaactcaggtgccaaactgctggttgctggtggatggcgtgaacaagccgaaactgtggttctatctgccggttgattactggcacaacgtcgaaccgctgccgacctctttctggactgaagatgtggaagtgatcgcgctgccgaaagccgatggcattggtagcctgctgcctgctgcgcgcggcaatatcggttatatcggtccggtgccggaacgtgcgctgcaactgggtattgaggccagcaacatcaacccgaaaggggttatcgactacctgcattactatcgctccttcaaaactgagtacgaactggcctgtatgcgtgaagcgcagaaaatggcggtcaacggtcaccgcgcggcagaagaagcgttccgttctggcatgagcgagttcgatatcaacattgcctatctgaccgcgaccggtcatcgtgataccgacgtaccttacagcaacattgtggcgcttaacgaacacgctgcggtactgcattacaccaaactggaccatcaggcaccggaagagatgcgcagcttcctgctggatgccggggcagaatataacggctatgcggctgacctgacccgtacctggtcggcaaaaagtgacaacgactacgcgcagctggtgaaggacgttaatgatgaacaactggcgctgatcgccaccatgaaagcaggcgtcagctatgtggattaccacatccagttccatcagcgcatcgccaaactgctgcgtaaacatcaaatcatcaccgatatgagtgaagaagcgatggtcgaaaacgatcttaccgggccgtttatgccgcatggtatcggccatccgctgggcctgcaggtgcatgacgtcgctggttttatgcaggatgatagcggtacgcacctcgcggcaccggcaaaatatccgtacctgcgctgcacccgtattctccagccgggcatggtgttaaccatcgaaccgggtatctacttcatcgaatcgctactggcaccgtggcgtgaagggcagttcagcaagcacttcaactggcagaaaattgaagcactgaaaccgttcggcggcattcgtatcgaagacaacgtggtgatccacgaaaacaacgtggaaaacatgacccgggatctgaaactggcgtgatggaaagctggttaattcctgcggcaccggtcacggtcgttgaagagatcaaaaagagccgcttcataacgatgttggcgcataccgatggcgttgaggcggcgaaagcgtttgttgaatcggtgcgggcagaacaccccgatgcccggcaccattgcgtggcgtgggtcgcgggtgcgccggatgattctcaacagctgggtttctctgacgacggggagccggcgggaacggcaggtaaaccgatgctcgcccagctaatgggcagcggcgtcggggaaattaccgctgtggtagtgcgctactacggcggcatattgcttggcaccggtgggttagtgaaagcgtatggcggcggcgtgaatcaggcgctgcgccagctaacgacccaacgcaagacgccattaaccgaatatactttgcaatgtgaatatcatcagttaaccggcattgaagcgttgctggggcagtgtgacggcaaaattatcaacagtgattatcaggcattcgttctgctgcgggtggcgcttccggcggcgaaagtggctgaattttccgcaaagctggcggattttagccgtggttcattgcaattgttagcgattgaagaataatccccacttcgttttgcagaactaaggaagcggcagagatgcattttcgcgccattacccgaatcgttggactactggtcatcttattttcagggaccatgattatccctgggctggtagcactcatctaccgggatggagcgggccgcgcttttacccagaccttttttgtcgccctcgccattggctctatgctgtggtggccgaaccgcaaagagaaaggcgaacttaaatcccgtgaggggtttctgatagtggtgctgttctggaccgtgctgggtagcgtcggtgcgctcccttttatcttctcggaaagcccgaacctcacgattaccgatgcgttttttgaatctttctctggcctgaccactacgggagccactacgctggtggggctggattcgctccctcacgccatcctcttttatcgccagatgctgcaatggtttggcgggatggggatcatcgtgttggcggttgcgatactgcctatcctcggcgtgggtgggatgcagctctatcgcgcagaaatgcccggcccgctgaaagataacaaaatgcgcccgcgaattgcggaaacggcgaaaaccctgtggttgatttatgtcttgctgaccgtcgcctgtgcgctggcgttgtggtttgccggaatggatgcctttgatgccatcggccatagctttgcgactatcgctattggcggcttctcgacacatgatgccagtatcggttatttcgatagcccgactattaacactatcattgctatcttcctgctgatctccggctgtaactacggtctgcacttttcactgttaagtgggcgtagtctgaaggtttattggcgcgatccggaatttcgcatgtttatcggcgtacagtttacgctggtggttatttgtaccctcgtactgtggtttcataatgtctacagttcggcgctgatgacaattaaccaggcgtttttccaggtggtgtcgatggcgacaaccgccgggtttacaactgacagcattgcccgctggccgctctttttgccggtactgcttttatgttcagcctttatcggcggttgcgccgggtcaacgggcggtggcctgaaggtgatccgcatcctgctgctgtttaagcaggggaaccgtgagctgaaacgactggtgcatccgaacgccgtctatagcattaagctggggaatcgcgcactgccggaacgtatcctcgaagccgtttggggatttttctccgcctatgcattggtgtttattgtcagtatgctggcgattatcgccacgggcgtggatgacttttctgcctttgcgtcggttgttgcgacattgaataacctggggccagggcttggcgtggttgctgataactttaccagtatgaacccggtggctaaatggatcctgattgccaacatgctgtttggtcgtctcgaggtctttacattgctggtgctctttaccccgactttctggcgtgaatgatggagtaatacgtgaaaacattaattcttttctcaacaagggacggacaaacgcgcgagattgcctcctacctggcttcggaactgaaagaactggggatccaggcggatgtcgccaatgtgcaccgcattgaagaaccacagtgggaaaactatgaccgtgtggtcattggtgcttctattcgctatggtcactaccattcagcgttccaggaatttgtcaaaaaacatgcgacgcggctgaattcgatgccgagcgccttttactccgtgaatctggtggcgcgcaaaccggagaagcgtactccacagaccaacagctacgcgcgcaagtttctgatgaactcgcaatggcgtcccgatcgctgcgcggtcattgccggggcgctgcgttacccacgttatcgctggtacgaccgttttatgatcaagctgattatgaagatgtcaggcggtgaaacggatacgcgcaaagaagttgtctataccgattgggagcaggtggcgaatttcgcccgagaaatcgcccatttaaccgacaaaccgacgctgaaataagcataaagaataaaaaatgcgcggtcagaaaattattttaaatttcctcttgtcaggccggaataactccctataatgcgccaccactgacacggaacaacggcaaacacgccgccgggtcagcggggttctcctgagaactccggcagagaaagcaaaaataaatgcttgactctgtagcgggaaggcgtattatgcacaccccgcgccgctgagaaaaagcgaagcggcactgctctttaacaatttatcagacaatctgtgtgggcactcgaagatacggattcttaacgtcgcaagacgaaaaatgaataccaagtctcaagagtgaacacgtaattcattacgaagtttaattctttgagcgtcaaacttttaaattgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagaggggtaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgaagtgctcacacagattgtctgatgaaaatgagcagtaaaacctctacaggcttgtagctcaggtggttagagcgcacccctgataagggtgaggtcggtggttcaagtccactcaggcctaccaaatttgcacggcaaatttgaagaggttttaactacatgttatggggctatagctcagctgggagagcgcctgctttgcacgcaggaggtctgcggttcgatcccgcatagctccaccatctctgtagtgattaaataaaaaatacttcagagtgtacctgcaaaggttcactgcgaagttttgctctttaaaaatctggatcaagctgaaaattgaaacactgaacaacgaaagttgttcgtgagtctctcaaattttcgcaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtgtgtgtgttagtggaagcgtctggaaaggcgtgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagccgcaaggcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaaggtgttttggcggattgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctcctcatgcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcattggcgcagaaaaaaatgccggatgcgacgctggcgcgtcttatccagcctactcttgcttatccgttctgcttttgcatccactccaccacaaaatcagccagcccctcaacatcattaatatccagtaatgcgacatcaagattaagcggcacatcactggctacagcaataacatgcctgtctatcactaattcttcaggtcgatgtccggctccatcgcgaaacagcacaatctttgcgatctcttcatgcttaaacccttcgaccagaatcaaatccagctttgaggtatccattcgacttgcgagaaactgtagatccagctcttcttcgtctggtgtttccgtcatcaaggcccatcgttgctggctggcaacgatggtttgtgccgcgccagccttgcgcagctcatagctatctttgcctggcttatcaacatccatatcatggtgcgtatgcttaatcagccctggacggatccctctggcgcataatgccgggatcagttttttcaaaagcgtagtttttccggtaccactccacgcggcaaaggcgagtaacggtatcatcgtttttcctgccatcgggcaagctcctctggcgtattcacgttaacaaatgcatctttatgatcgctgaaatcaaccgcatgaccgccagccagacgcataaataccattacccggcgttctcctgcttgcagatattccagtaataaaggctcaatagcgcggtttaccagagcaatagtcgggtgatcgcgttcaccgtcatggacccacacgacaggcgcatctttgcgctgatgattaagcctggctgctaaatcagggggaatgtaaggcgtatcgcacgggcaaaacaaaaaccactcaccagcttcctgctgcattactgaaagcattcctgccagagggcctgggtaatccgccagtgaatcttcaatcactttcagaccgcttgcctgatagatttcctgatgacgattagcattaaccacgacgtgagagagctgcgtcataagcgcgtcagcgacatgttgccataatggtttgccgtttaattcaagcaatcctttatctacgccgcccattcgtctggctttaccgcctgccagcacaacgcctgttatcgtcgtcatcagattcaccgatatcgcctcttttattgtgggattgaccctgctaacgtgtctgtctcaagagtaaggagcatcactatgaaatgtaaacgtctgaatgaagttattgaactcctccagccagcctggcaaaaagagccagaccttaacctgctgcaatttttgcagaaactggcgaaagagtcaggttttgacggcgaactggcggatttgacggatgacattctgatctatcacctgaaaatgcgtgattccgcgaaagatgcggtgatcccgggtttgcagaaagattatgaagaagacttcaaaacggcgctgttacgcgctcgcggcgtaattaaagagtaaaagcttgtaagcggcgccaccaaaatcatcgtgaaatgatatccttcgtcattcgtaatgttttccggatgatgggatgaataacagcgcttttactttccagacactacacccggataccatcatggacgctctgtttgagcatgggatccgggtggattccggtcttaccccgcttaacagctatgaaaaccgtgtctatcaatttcaggacgaagatcgtcgacgttttgtcgtcaaattttatcgccctgaacgttggacagccgatcaaatcctcgaagaacatcaatttgcgttgcagctggtaaatgatgaagttccggtcgcagcacctgtggcctttaacggtcagactttattgaatcatcagggattttatttcgctgtttttccaagcgtcggtggtcgccagttcgaagctgataatatcgatcagatggaagcggttgggcgttatttagggcgtatgcaccagacggggcgcaaacagctttttatccatcgcccgaccatcggtttgaacgaatatctcattgagccacgcaagctgtttgaggacgctacactgataccttccgggttgaaagcggcattcctgaaagcgacagatgagctgattgccgccgttacagcacactggcgggaagatttcaccgttctgcggctacatggagactgccacgccgggaatattctctggcgcgatggtccaatgtttgttgatctggatgatgcacgtaatggtccagccgttcaggatttgtggatgttgctcaatggcgataaagccgagcagcggatgcaactggaaactattattgaagcttatgaagaatttagcgagttcgacaccgctgaaatcggactgattgaacctttacgcgccatgcgtttggtttattatcttgcctggctaatgcggcgttgggctgatcccgcgttcccgaaaaatttcccgtggttaaccggggaagattactggctgcgacagacggcgacttttatagaacaggcaaaagttctacaagaaccccctttgcaattaacacctatgtattaatcggagagagtagatcatgaaaaagatttggctggcgctggctggtttagttttagcgtttagcgcatcggcggcgcagtatgaagatggtaaacagtacactaccctggaaaaaccggtagctggcgcgccgcaagtgctggagtttttctctttcttctgcccgcactgctatcagtttgaagaagttctgcatatttctgataatgtgaagaaaaaactgccggaaggcgtgaagatgactaaataccacgtcaacttcatgggtggtgacctgggcaaagatctgactcaggcatgggctgtggcgatggcgctgggcgtggaagacaaagtgactgttccgctgtttgaaggcgtacagaaaacccagaccattcgttctgcttctgatatccgcgatgtatttatcaacgcaggtattaaaggtgaagagtacgacgcggcgtggaacagcttcgtggtgaaatctctggtcgctcagcaggaaaaagctgcagctgacgtgcaattgcgtggcgttccggcgatgtttgttaacggtaaatatcagctgaatccgcagggtatggataccagcaatatggatgtttttgttcagcagtatgctgatacagtgaaatatctgtccgagaaaaaataattcaatgtaaattacataaagcccgtgaatattcacgggctttttttattatttaataaatataaatacattctgataatgcatcctgccgctggacattatttcagcataagtggatattcaaagttttgctgttttatcagggaatatttatatgatacgtaagtcagctacaggtgttattgttgcgttagccgtaatctggggtggtggcacatggtacacaggtacgcaaattcagcctggtgtcgaaaaatttattaaagattttaacgatgctaaaaagaaaggtgaacatgcctacgatatgacgttaagttatcaaaattttgacaaaggcttttttaattcccgttttcaaatgcaaatgacattcgataacggtgcacccgatctcaatatcaagccaggccagaaagttgtatttgatgtggatgttgagcacggtccgttgcccatcacaatgttaatgcatggtaatgtcatcccagcactggcagcggcaaaagtgaacttagtgaataatgaactgacacaaccgctatttatcgccgcgaaaaataaatcgcccgtggaagcgacattgcgattcgcgtttggtggctcattctctacgacattagatgttgcccctgcagagtatggaaagttttcttttggtgagggccagtttacttttaatggtgatggtagttcattgtctaacctggatattgaaggcaaagtcgaagatattgttctgcaattatcaccaatgaacaaagtaacggcaaaaagttttaccattgattctctggcgcgattagaagaaaagaaatttccggttggtgaaagcgagtcgaaatttaatcagattaacattatcaatcacggggaagacgttgcccaaatcgatgctttcgttgcaaaaaccaggctggatcgcgttaaagacaaagattatatcaatgtcaatctcacctacgaacttgataagttaacaaaagggaatcagcaactcggtagtggtgagtggtcattgattgctgaatctattgatccctcagcagtgcgccaatttatcatccagtataacattgcgatgcagaagcagcttgctgcacaccctgagttagcaaacgatgaagttgctctgcaagaagtgaatgctgcattgttcaaagagtatttaccgttattacaaaaaagtgagccgaccattaaacaaccggtaagatggaagaacgcactcggcgaactaaatgccaatctggatatcagtattgccgacccagccaaatcttcatcatccacaaacaaagatatcaaatcgctcaattttgatgtgaagttaccgcttaatgtcgtcacagaaaccgcaaaacagcttaatttatctgaaggaatggatgcggaaaaagcgcaaaagcaggctgataaacaaatcagcgggatgatgacattaggtcagatgtttcagttaatcacgattgacaacaataccgcctcgctgcagctgcgttatacaccgggtaaagttgtttttaacggacaggagatgagcgaagaagaatttatgtctcgtgccggacgttttgttcattaaaatactcactcgcctctgctcattcagaggcgagtaaaacttacttattctgacgctgtgatgacatgagagacgtcagaagccggtctttttcctgccacaatgagttcagccattgctgaaaatggcgcttaaagcttttgtcattgatgtagtcgccatgtaactcatcggcaataggctgtaaatccacatgtacgacaatccgcgtcagtttaccgcttaacatatcgaagaacggctgacggttattgtccggataacacagcgtaacattaagcagtttatcgaattgtttacccagtacatttagcgccatcgcaatgcctgccgcctttggtggcaacaagttttgaaaagtggagtgggtttgctgatgtttttcttgcgtgaaacgggagccttcaacgaaattgacaatggtggtgggatgcaggcgaaacttttcacaagaacgccgagtggtttcaacatctttaccacgtcgctccggatgacgtaataaataagcgcgggaataacgcttcataaacggcatatccagcgaccagcacgccaggccaagaaatggcacccaggccagctgttgcttgaggaaatatttattcatcggaatgtgcttacgaaacagcacgcacagtacgacaatatctgcccaactacggtggttacaaataagcagataccagttcttcttacttaacccttccagcccgtgaacttcccattgaaggtgtgggttcagatgcagtaataccgccagaccttcacaccagcaatacatcataaaatcacaaaaacgcgaaacctttcgccaaatgactggcacaggtagcaatagttttacaatcccggcaatgatgatcgggacggaacaaaaaatagtgaccaaaatggtcaatacgatactcagcaaaagggttatcgcagcgagtattctcgtcataatgaatttattcaaaaggttagccatagacagtgcgctaaagaagcgcaaggcgcagattttagcagaaaacgacccaaataacggatgatccttaaggagaaaaataattcatatctatccacattagaaaaaatcccattatctcaattattagggatggatttatttttaactgcatgaaaaacaaagacaaacatcatgctgtaaaaagcatgataataaattaaaagcgatgtaaataatttatgcacaaagttatccacatgacgatttgcgagcgatccagaagatctacaaaagattttcacgaaaagcggtgaaaaactcatgttttcatcctgtctgtggcatcctttacccataatctgataaacaggcacggacattatggttcagatcccccaaaatccacttatccttgtagatggttcatcttatctttatcgcgcatatcacgcgtttcccccgctgactaacagcgcaggcgagccgaccggtgcgatgtatggtgtcctcaacatgctgcgcagtctgatcatgcaatataaaccgacgcatgcagcggtggtctttgacgccaagggaaaaacctttcgtgatgaactgtttgaacattacaaatcacatcgcccgccaatgccggacgatctgcgtgcacaaatcgaacccttgcacgcgatggttaaagcgatgggactgccgctgctggcggtttctggcgtagaagcggacgacgttatcggtactctggcgcgcgaagccgaaaaagccgggcgtccggtgctgatcagcactggcgataaagatatggcgcagctggtgacgccaaatattacgcttatcaataccatgacgaataccatcctcggaccggaagaggtggtgaataagtacggcgtgccgccagaactgatcatcgatttcctggcgctgatgggtgactcctctgataacattcctggcgtaccgggcgtcggtgaaaaaaccgcgcaggcattgctgcaaggtcttggcggactggatacgctgtatgccgagccagaaaaaattgctgggttgagcttccgtggcgcgaaaacaatggcagcgaagctcgagcaaaacaaagaagttgcttatctctcataccagctggcgacgattaaaaccgacgttgaactggagctgacctgtgaacaactggaagtgcagcaaccggcagcggaagagttgttggggctgttcaaaaagtatgagttcaaacgctggactgctgatgtcgaagcgggcaaatggttacaggccaaaggggcaaaaccagccgcgaagccacaggaaaccagtgttgcagacgaagcaccagaagtgacggcaacggtgatttcttatgacaactacgtcaccatccttgatgaagaaacactgaaagcgtggattgcgaagctggaaaaagcgccggtatttgcatttgataccgaaaccgacagccttgataacatctctgctaacctggtcgggctttcttttgctatcgagccaggcgtagcggcatatattccggttgctcatgattatcttgatgcgcccgatcaaatctctcgcgagcgtgcactcgagttgctaaaaccgctgctggaagatgaaaaggcgctgaaggtcgggcaaaacctgaaatacgatcgcggtattctggcgaactacggcattgaactgcgtgggattgcgtttgataccatgctggagtcctacattctcaatagcgttgccgggcgtcacgatatggacagcctcgcggaacgttggttgaagcacaaaaccatcacttttgaagagattgctggtaaaggcaaaaatcaactgacctttaaccagattgccctcgaagaagccggacgttacgccgccgaagatgcagatgtcaccttgcagttgcatctgaaaatgtggccggatctgcaaaaacacaaagggccgttgaacgtcttcgagaatatcgaaatgccgctggtgccggtgctttcacgcattgaacgtaacggtgtgaagatcgatccgaaagtgctgcacaatcattctgaagagctcacccttcgtctggctgagctggaaaagaaagcgcatgaaattgcaggtgaggaatttaacctttcttccaccaagcagttacaaaccattctctttgaaaaacagggcattaaaccgctgaagaaaacgccgggtggcgcgccgtcaacgtcggaagaggtactggaagaactggcgctggactatccgttgccaaaagtgattctggagtatcgtggtctggcgaagctgaaatcgacctacaccgacaagctgccgctgatgatcaacccgaaaaccgggcgtgtgcatacctcttatcaccaggcagtaactgcaacgggacgtttatcgtcaaccgatcctaacctgcaaaacattccggtgcgtaacgaagaaggtcgtcgtatccgccaggcgtttattgcgccagaggattatgtgattgtctcagcggactactcgcagattgaactgcgcattatggcgcatctttcgcgtgacaaaggcttgctgaccgcattcgcggaaggaaaagatatccaccgggcaacggcggcagaagtgtttggtttgccactggaaaccgtcaccagcgagcaacgccgtagcgcgaaagcgatcaactttggtctgatttatggcatgagtgctttcggtctggcgcggcaattgaacattccacgtaaagaagcgcagaagtacatggacctttacttcgaacgctaccctggcgtgctggagtatatggaacgcacccgtgctcaggcgaaagagcagggctacgttgaaacgctggacggacgccgtctgtatctgccggatatcaaatccagcaatggtgctcgtcgtgcagcggctgaacgtgcagccattaacgcgccaatgcagggaaccgccgccgacattatcaaacgggcgatgattgccgttgatgcgtggttacaggctgagcaaccgcgtgtacgtatgatcatgcaggtacacgatgaactggtatttgaagttcataaagatgatgttgatgccgtcgcgaagcagattcatcaactgatggaaaactgtacccgtctggatgtgccgttgctggtggaagtggggagtggcgaaaactgggatcaggcgcactaagattcgcctgaacatgccttttttcgtaagtaagcaacataagctgtcacgttttgtgatggctattagaaattcctatgcaacaactgaaaaaaaattacaaaaagtgctttctgaactgaacaaaaaagagtaaagttagtcgcgtagggtacagaggtaagatgttctatctttcagaccttttacttcacgtaatcggatttggctgaatattttagccgccccagtcagtaatgactggggcgttttttattgggcgaaagaaaagatccgtaatgcctgatgcgctatgtttatcaggccaacggtagaattgtaatctattgaatttacgggccggatacgccacatccggcacaagcattaaggcaagaaaattattcgccgtcctgcgtttcttctacaggctgcatctcgctaaaccaggtatccagtttctgccgcagcttgtccacgccttgtttcttcaacgaagaaaacgtttcaacctgcacatcaccgttaaacgccagtacagcttcacgcaccatattcaattgcgctttacgtgcgccgcttgccagtttgtccgctttggtcagcagcaccagaacggcgatattgctgtctaccgcccactcaatcatctgctgatccaaatctttcagcggatggcgaatatccattagcaccaccagaccttgcaggctctgacgtttttcgaggtattcgccgagcgcacgctgccatttgcgcttcatctcttccgggacttccgcataaccgtacccaggcaagtcaaccagacgcttgccgtcagccacttcaaacaggttgataagctgggtgcgccctggggtttttgaggtacgagccaggcttttctggttagtcagcgtgttcagcgcgctggatttacctgcgttggaacggcctgcaaaagccacttcaattccggtatcggaaggtaggtggcgaatatcaggcgcactcatcacaaaatgcgtctgttgataattcaaattagtcaaagcggtcgtctccgtcagtcaaagctttgtggcgattatacctgaaccataataaaaggcggatttttcggcgtgagcgttgtaagtaaaagccatacgctttgtgagacattgccgatagtctttatgcgaaatagcagagaaaattctgcgatgcatgtcaaataagctatataaatcagtgaattgcttttatataaaactctgaaaatgtgcaaatactgatggcggttgattgtttgtttaaagcaaaggcgtaaagtagcacccatagagcgaggacgctaacaggaacaatgactcaggatgagggtcaggagcgccaggaggcgaagacagaggattgtcaggaagacaaacgtccggagacgtaattaaacggaaatggaatcaacacggattgttccggctaaaggaaaaacagggtgtgttggcggcctgcaaggattgtaagacccgttaagggttatgagtcaggaaaaaaggcgacagagtaatctgtcgccttttttctttgcttgctttctgttagattccgccgcaaatctatactgaataaaacggctaaaagacgaaccattatgaaaccatcatcttcaaactcacgcagcaaaggtcatgcaaaagcgcgtcgaaaaacacgcgaggagctggatcaggaagctcgtgatcgcaagcgtcagaaaaaacgtcgtggtcatgcgccgggcagccgcgcagcgggcggaaacaccacgtcaggcagcaaaggccagaacgcaccaaaagatccacgtattggcagtaaaacccctattccattgggcgtgactgaaaaagtcaccaaacagcacaaaccgaagagtgagaaacctatgctttcaccgcaggcggagttggaattactggaaacggatgagcgtctggatgcgctgctggaacgtctggaagcaggcgaaaccctgagtgccgaagagcaatcctgggtggatgctaaactggatcgtattgatgagttgatgcagaaactcggcctctcttatgacgatgacgaagaagaggaagaagacgagaagcaagaagacatgatgcgtctgctgcggggcaactaacggattgccgccgtgggccttcccgttctgctgataacccttccggttatatgttatctggtgtggttattcgttaaactacagcggttgtcgcggcgacaaaagtggctgcgcaaccggctgatgacccgaaacgggcatccgccggtacgccgtagccgccagagacgccatcggaaggagtgagcatgtctgtacagcaaatcgactgggatctggccctgatccagaaatataactattccgggccacgatacacctcgtacccgaccgcgctggagttttcagaagacttcggcgaacaggcgtttttacaagccgtggcgcgctatcctgagcgtccattatctctctacgtacatatcccgttctgccataagctttgttacttctgcggttgcaataagattgttactcgccagcagcacaaggccgatcagtatctggacgcgctggagcaagaaatcgtccatcgtgcaccgctgttcgccgggcgtcacgtcagccaattgcactggggcggcggaacgccgacgtatctgaataaagcgcaaatcagccgcctgatgaagctgctgcgcgaaaacttccagttcaatgccgatgcggagatttcgatcgaagtcgatccgcgggaaatcgaactggatgtactcgatcatttacgcgccgaaggctttaatcgcctgagcatgggcgtgcaggacttcaacaaagaagtgcaacgtctggttaaccgcgagcaggatgaagagttcatctttgcactgcttaaccatgcgcgtgagattggttttacctccaccaacatcgacctgatttacggcctgccgaaacagacgccggagagtttcgcctttaccctgaaacgtgtggcggagctgaaccccgatcgtctgagtgtctttaactacgcgcatctgccgaccatttttgctgctcagcgcaaaatcaaagatgctgacctgccgagtccgcagcaaaaactcgatatcctgcaggaaaccatcgccttcctgacgcaatcgggctatcagtttatcggtatggatcactttgcccgtccggatgacgagctggcggtggcccagcgtgaaggcgtgctgcatcgtaacttccagggctacaccactcagggcgataccgatctgctggggatgggcgtttccgccatcagcatgattggcgactgctacgcgcagaaccagaaagagttgaagcagtactatcagcaagtggatgaacaaggcaatgcgctgtggcgtggtattgcgctaacgcgtgatgactgtattcgccgcgatgtgattaagtcgctcatctgcaacttccgtctggattacgcccctattgagaaacagtgggatttgcacttcgctgattactttgcggaagatctcaagctgctcgccccgttagcaaaagatgggctggtggatgtggatgagaagggaatacaggtgacggcgaaaggtcgcttgctgatccgcaacatttgcatgtgctttgatacctatctgcgccagaaagcgcggatgcagcagttctctcgggtgatttaaatagtgaatggcgcttcgtttacaaagtagaaaacgaaagcgccatcaatgtgctgagaacaagattgcctgatgcgctgggcaacaaaacctgttgaaattattgcttttgtaggccggataaggcgtttacgccgcatcaggcatctgagcatgatgcctgatgcggcgctggtcgcgtcttatcaggcctacgactttctccgcatccggcataaacaacgagcttcagctaaacagcccaatcattgcggcacacagcacggcagcaacggcagtttgcggtgtgtggctgtcaactgcgccactcgataccagattaattattgattccagcataatgactctccccgttttccgggcaagatcatactgaacttatcggaacagtaaagcgtaaaataccagcaatttgcgctcaataatcaatctttacacacaagctgtgaatcactccatccccagctcttttaacttacgcgtcagggtgttgcggccccagccgagtagccgcgccgcttcctgtttatgcccctgcgtatgtcgcaacgcggtcgtcagtaacgtccgctccagctctggctgcgcttcggaaagcagattttgatgaccggaacgcagcgctctgtctgcccactgcgcaagaagcgtcgcccagctgtccggttgcatttgcgaagtactctccgcaaccgttgattcaaacagttcgccgggcaaatcctgaatcaacacttcctgcccggcggccatcaccgttagccagcggcaggtgttttccagctggcgcacgttgcctggccacgccagacgcgtcagagcagcttcggtttccggatgcagtaacttcgcttctacgcccagttcgcgcgcggcaacctgtaaaaaatggcgcgccagacggggaatatcttcccgacgttcgcgcagcggcggcagatgaacgcggataacgttcaggcggtggaacagatcctcacggaacttaccttcctgcactcgctgttcgagattctggtgagtggcagcgataatccgcacatccactttcaccggcgcatagccgccaacgcggtaaaactgaccgtctgccagcacgcgcagcaaacgcgtctgcacatccagcggcatatcaccaatttcgtcgaggaataatgtaccgccatcggcctgttcaaaacgcccctgacgaatggtattcgcgccagtaaacgcgcctttctcgtggccaaacagttctgattcgatcaaatcttttgggatagctgccatattcagcgcgataaacggcgctttggcgcgcggactgtggcgatgcagggcatgagcgaccagttctttaccggtgccggattcgccgttaatcagcacgctaatagaagaacgcgaaagccgaccgataatacggaacacgtcctgcatggctggcgcttcgccgatgatatcggtcgttgggccgttaagctgaacattacgcggctgctgctgttcctggtaatgactgatagcgcgctcaaccagcgccactgcttcgtcgatatcaaacggtttgggcagataatcaaacgccccttgttgataggcgctgacggcagcatccagatcggaatgtgcggtcataatgatgaccggaagcattggatggcgctgtttaatctgcttgagcagcgccagcccgtccattcccggcatacggatatctgaaagcagcacatccggcgttttgctcgccagcgcctccagcacttctgcgccgttctcaaacgtcgtacaggttaaacctgccccagcgagcgcacgttcaagcacccaacggatggaactatcgtcatcgactacccagactatccctcgttgcataaacgtcacctttatttcctgataggcaggtaaaccgagaactcggtatgccctggccaactggtaaattcaattttgcctgaatgctgatcaatcaaattacgagcgatggataagccaagcccggtgccaccttcgcggccgctgaccatcgggtaaaacagcgtatcctgcaaatgaggcggaatgcccggcccgttatcttccacatcaatccgcgccgccagccggtagcgctcgccgtgtaaggtcagttgaaacgcggtgcgggtacgcagaatgatttcaccgccttccggccccagcgcctgtagcgcattgcgcacaatattcagcaagacctgttcaatttgatccgggtcgtgcgccagttccggtaggctgggatcgtaatcacgaatcaaccgcacgttgtccggcagttccatcgacaccagcgttaccacgcgttcagccactttgtgaatactttcggtaacgcgcgtaccgggcagctgcggccccaacagacggtcgaccagatttcgcagccggtccgcctgttcgataatcactttggtatattcgagtagtgatgggtcaggtaacgctttgctgagcagctgcgccgcgccacgtaaaccgccaagcggatttttaatctcatgtgccaggccgcgcactaaatcacgggcagcaacctgctgggcgtgctgtagctgttcctgacttaagcggcgctggttatccatcggagccatctccagcaggatcatgccgtccggcatacgctgggccgtcacagaaaggatatgcgagcgcccgtcgatgaccagcgtcacttcgttatcggtaaaaccttgccccgcctccagactttcttgcatcagctcgatatttaatgagaagtagctcaacagttccggtaacggtgtaccaaacaatttgcgggagctttgggcgagcagttgttgcgcggcagggttggcgtaatggatcgccaggttgtcatcgattaacaaaatactgttaatcagcgagttgaggatctgcccagcatcgggctgcgtgcctgttgccataaagcagtctcctgaacaggttgcaccattttagtgcattatagctttttacggataaaaagcgcgaagcatcagagaattgacggagaaaaaagcccatgcagagatgggctacagatagctgacaaacttcacgttggagagcgactcacctgctccggcctaccacatcatcaccgtgtaggccggataagacgcatttgcgtcgcatccggcgtgatgtgcttgccaccgatcccaggcctgccagagacaggcgaaaagtttccacggcaactaaaacacttagacgctgtagtacagctcaaactctaccggatgcggagtcatacgcacgcggtcatcttcttcgcgacgcagagcgatgtacgcatcaattgcttcgtcagtgaacacgccaccggctttcaggaactcgcggtccagatccagttcgttcagtgcttcttccagagagcctgcaacctgtgggatctctttcgcttcttctggcggcaggtcatacaggtttttgtccatggcttcgcccggatggatcttgttcttgataccatcaagaccggccatcagcagggcagcaaagcacaggtacgggttagctgccggatccgggaaacgtacttcgatacgacgtgctttcggagaagaaaccaccggaatacggatagacgcagaacggttacgcgcagagtaagccagcattaccggtgcttcatagcccgggaccagacgcttataagagttggtggtcgggtttgccagggcgttaatcgctttagcgtgtttgattacgccgccaatgtagtacagcgcctgctcagacagacctgcgtatttgtcgcctgcgaacaggttaacgccgtttttagacagagacatgtggcagtgcataccggagccgttatcaccgaacatcggttttggcataaaggtcgcggttttaccgaagcggtgcgctacgttgtgcacaacatatttgtagatctgaatttcgtcagcttttttggtcatggtattgaagcgggtagccacttcgttctgaccagcagtcgctacttcgtggtgatgggcttcaaccaccagacccatctgttccatcaccagacacatttcagaacgaatatcctgagccgagtctaccggtggaaccgggaagtaaccgcctttcactgccggacggtgacctttgttaccaccttcgtattgggtggaggagttccatgcgccttcgatatcgtcgatagcaacgtgggaaccggagatagatgatccgaaacggatgtcatcgaacaggaagaattcaggttctggcccgaacagtacggtgtcggcaatgccagtggaacgcaggtaatcttcggcgcgcttcgcaatggagcgcgggtcacggtcatagccttgcagggtgccaggttcaaggatgtcgcaacggataatcagggtggagtcggcgaagaacgggtcaatcactgcggtggatgcgtctggcatcagcaccatgtcggactcgttaatgcctttccagccgccaatcgaggagccgtcaaacattttgccttcttcgaagaattcagcattcacctgatgagcagggatagtgacgtgctgttctttacctttagtatcggtgaagcgcaaatcaacaaacttcacttcgtgctcgttcagcatcgtcagtacgtgttcagcggacatactttaactctcctggattggtcatggtcgtcgtggtaacgaaatctgcaattattttggccgtgtcgccgtaaaaaagataaagcgaaatctgtgccaacttttaaattgcccctaaaaggcgttatcatgcgcaccatcgtgcaaaagggctgcaccacgatgtgaatgttgcaccaatatagtgcttcaatggaaacattaagcaccatgttggtgcaatgacctttggataaccctttttatgctccgtgaaagcgatcacaaagggactctgcaatacttgtttgcggaggatgtttgtgatcctgttttgtagtgcgattaatccgtgtacaataacgcgctatttctaatgcctgaggcaaagttgtgatcgaaaaattgcgtaatatcgccatcatcgcgcacgtagaccatggtaaaaccaccctggtagacaagctgctccaacaatccggtacgttcgactctcgtgccgaaacccaagagcgcgtgatggactccaacgatttggagaaagagcgtgggattaccatcctcgcgaaaaacaccgctatcaaatggaatgattaccgtatcaacatcgttgataccccggggcacgccgacttcggtggtgaagttgaacgtgtaatgtccatggtagactcagtgctgctggtggttgacgcatttgacggcccgatgccgcaaacgcgcttcgtaaccaaaaaagcgtttgcttacggcctgaagccgattgttgttatcaacaaagttgaccgccctggcgcgcgtcctgattgggttgtggatcaggtattcgatctgttcgttaacctcgacgcgaccgacgagcagctggacttcccgatcgtttacgcttctgcgctgaacggtatcgcgggtctggaccacgaagatatggcggaagacatgaccccgctgtaccaggcgattgttgaccacgttcctgcgccggacgttgaccttgacggtccgttccagatgcagatttctcagctcgattacaacagctatgttggcgttatcggcattggccgcatcaagcgcggtaaagtgaagccgaaccagcaggtcactatcatcgatagcgaaggcaaaacccgcaacgcgaaagtcggtaaagtgctgggccacctcggtctggaacgtatcgaaaccgatctggcggaagctggcgatatcgttgcgatcacgggccttggcgaactgaacatttctgacaccgtttgcgacacgcaaaacgttgaagcgctgccggcactctccgttgatgagccgaccgtttctatgttcttctgcgttaacacctcgccgttctgcggtaaagaaggtaagttcgtaacgtctcgtcagatcctggatcgtctgaacaaagaactggtacacaacgttgcgctgcgcgtagaagaaaccgaagacgccgatgcgttccgcgtttctggtcgtggcgaactgcacctgtctgttctgatcgaaaacatgcgtcgtgaaggtttcgaactggcggtatcccgtccgaaagttatcttccgtgaaatcgacggtcgtaaacaagagccgtatgaaaacgtgactctggacgttgaagaacagcatcagggttctgtaatgcaggcgctgggcgaacgtaaaggcgacctgaaaaacatgaatccagacggtaaaggccgcgtacgtctcgactacgtgatcccaagccgtggtctgattggcttccgttctgagttcatgaccatgacttccggtactggtctgctgtactccaccttcagccactacgacgacgtacgtccgggtgaagtgggtcagcgtcagaacggcgtactgatctctaacggtcagggtaaagcggtcgcgttcgcgctgttcggtctgcaggatcgcggtaagctgttcctcggtcacggtgcagaagtttacgaaggtcagattatcggtattcatagccgctctaacgacctgactgtaaactgcctgaccggtaagaaactgaccaacatgcgtgcttccggtactgacgaagccgttgttctggttccgcctatccgcatgactctggaacaagctctggagttcatcgatgatgacgaactggtagaagtgactccgacctctatccgtattcgtaaacgtcacctgacggaaaacgatcgtcgccgcgccaaccgcgcaccgaaagacgattaatttcgttttttagtcataaaaaacctgccagcgatggcaggtttttttttgcctgtcgtgagcgcacaccaatgcgagtatctcccttataagtctgtggttacgtcaatagagagctttgtcacaattatctgcaaagtcatacgccgttaattgctttcttttttggcgtaagcgtaagatgcttcatctggtttaaaccaaaaggattaaacaatggcggagaatcaatccaccgtagaaaatgcaaaagagaaactggatcggtggttgaaagatggcatcaccacgccgggtggaaaactcccttcagaaagagagctgggagaactgctgggcattaaacgtatgacgctgcgccaggcgttgttgaacctcgaggcagaatccaaaatcttccgtaaggatcgtaaggggtggttcgtgacccagccgcgatttaattacagtccggagctgtcggcgagctttcagcgggccgcaattgagcaagggcgagagccttcctgggggtttaccgagaaaaaccgtaccagcgatattcccgagacgctcgcgccactgattgcagtgacgccatcaactgaactctatcgcatcaccggctggggggcgctggaaggacataaagttttctatcacgaaacatatattaatcctgaagttgctccgggctttattgaacaacttgaaaaccactcattttctgcagtctgggaaaagtgctaccaaaaagagacggtagtaaaaaaattgattttcaaacccgtcagaatgccgggcgatatcagcaagtatcttggcggttctgcgggtatgccagcgatcttaattgaaaagcatcgcgccgaccagcaaggcaatattgtccaaatagatattgaatattggcgatttgaggccgtagacctcatcattaatctgtaggtgttttatggtgacaataaataacgcaagaaagattctacaacgtgtcgacactcttcctctttatttacatgcttatgcctttcatttaaatatgcggctggaaagagtgttgcctgctgatttacttgatatcgcaagtgaaaataatctacgtggcgtcaaaatccatgttctcgatggcgagcgtttttctcttggtaatatggacgataaagaactctctgcctttggggataaagcccgccgtctgaaccttgatattcatattgaaaccagcgcctcagataaggcatctattgacgaagccgtcgccatcgcgttgaaaactggggcatcgtccgtacgtttttatccacgttatgaaggtaatttgcgcgacgtattatcgattatcgctaacgacattgcctatgtacgggaaacgtatcaggacagcggcctgacttttacgatcgagcagcatgaagatttaaaaagtcatgagctggtgtcgctggtcaaagaaagtgagatggaatctctttccttactgtttgattttgcgaacatgatcaatgcaaatgagcatcccatcgacgctttaaaaacgatggcaccgcatattacccaggtccatatcaaagatgccttgatcgttaaagaaccgggtggcctgggtcataaagcctgtatttcaggtcagggtgatatgccgttcaaagcgttattaacgcaccttatctgcctgggtgatgatgagccgcaggtgacggcatatggcctggaagaagaggttgattactatgcgccggcgttccgctttgaagacgaagatgataatccgtggatcccttatcgccagatgagtgaaacaccattgccagaaaatcatttactggatgcgcggttacgtaaagaaaaagaagatgcaattaatcagataaatcatgtgcgtaacgtactacaacaaatcaaacaagaggcaaaccatcttctgaaccactaataagttttaactcatacgcagttaataaaaccattccatatgaatggtcggtatcttattgcctttaaaacagtgattttaaaaatcgcttaggggatgttatgctcacgaaaaagaaatgggcgttatttagtctattaacactgtgtggcggtacaatttataaattaccgtcgctgaaagatgcgttttatatcccgatgcaggaatatttccatttgaccaatggtcaaattggtaatgctatgtcggtaaactcatttgtcaccacagtgggcttttttctgtctatttattttgccgataaactaccgcgcagatacaccatgtcattctcactcattgcgacaggattactgggtgtttatttgacgacaatgccggggtattggggcatcctctttgtctgggcgctatttggcgttacttgcgacatgatgaactggccggtcttgctcaagtcggtaagtcgattgggcaatagcgaacaacaaggtcggttgtttggcttcttcgaaacagggcgtggcattgtcgataccgtggtggcattttctgcgttggcagtatttacctggtttggcagtggcttattaggttttaaagcaggcatctggttctattcccttattgtgattgccgtaggcattattattttctttgtcctgaatgacaaagaagaggcaccgtccgttgaggtgaaaaaagaagacggagcatcgaaaaacaccagtatgacctcggtgctgaaagacaaaactatctggcttatcgcttttaacgtcttcttcgtttacgcggtttactgtggcctgacattcttcattccattcctgaaaaacatctatctattgcccgttgcgctggtgggggcttacggcatcattaaccaatactgtctgaaaatgattggtggaccgattggtggcatgatttcagataagatcctgaaatcgccaagtaaatatctatgctacacctttatcattagtaccgctgcgctcgtactgttgattatgctgccgcacgaaagtatgccggtctatttagggatggcatgtacgctgggctttggcgcgatagtctttacacagcgagccgtattttttgcacctatcggcgaagcaaaaattgctgaaaataaaacaggtgcggcgatggcgttgggtagctttattggttacgctccggcgatgttctgcttcagtctgtatggctacattctggatttaaatccggggattattggctacaaaatcgtgtttggcattatggcctgcttcgcattcagtggtgcggtggtttccgtaatgctggttaagcgtattagccaacgtaagaaagagatgctggcggctgaagcttaattaatggccggatgtgcttaatccggccaacgaaaaccgtatcaaccgtaggccggataaggcgtttacgccgcatccggcagtttcacatcagaagaaatacttcgtcccgatacggatctggttttgctcgcggtggtacggttcgacgttgcggtctaaccagcgcaattcgaaataagggagccagtgttcattaatacggtaacggaaggtgttagtgatttcccaatgatgatctttcccgttgctactattaaagtcattcactcgcatgaagtaatgtggctcaaatgtataggaaaatttatcggtgattttaaaattccagtaggtgccaatttcataggtgtcattattatccagttccccgctcaaatctgttgaactatagttattatggttatagcgatttcgtactgtcagattaaaccatggtacaaatttatagttgacgtccagatacactgcaccacccgaaccgatactcttatcattaattaagccaccgggctggatggttaatttatcggttggtttaaataacggataccagccttcaatttcgttatatccatgttttagttcatcttctcgctgaaagttgtaggtattggttaacataatacccgcgcccatatcgaagttataacccacacgtagcataacctcgccctgatcggaggcaagattatatgcctccctgttttcgacgtatgcgccagcaaataccgaggcagaggtcagagaagataataaaattattgcattaatctttttcataataagtccattttttaaacgtagggaggccgccacccaccaggatggaaatagcggctattgacatttataacgttacggaagccgttttttcttctgtcgccatctctttatttttgcgttggttgatttcctcaataatcaatgcaaaccgtttttcattgagtgtgtaaaagaatcccatcgtcaatgcagcaataattgccagtgcacaaggccagataaaaatgagctgacgcaaaccctgtaatgtcgcatcgctttgcgcgatgttgggaacataaccaatttgcgtcagcataatgcctggcaagaagccagcaagtgcggcagaaattttacgaaagaaggtataaccggtataaacagaaccttcggcacgaataccggttttccattcaccgtaatctacggtatctggtaccagtgcccagttcaggctgtttacaaaggccgtgccaaaaaaggcgacacaagagaacatgacgaaagtgaaagagttacttccccagaaataattcagtatatcacccaccgcccacagcaccatgccagccagataaacctgttttttaccaaaacattttacagttaatggcaccagtaatacgccgatgaggatgcatcccatactgaagaatcccatccacgacaataaattaatatcattcagcacatactgggtgtaatagacctgaatcgccagtttgatattaaatgccgccagggtacacaagttagcaatgcataaaaccagcaatggcggattccgaaatatcgcgcaaaatgatttgagaatactggctttatgtccggttggcgttgtgtccacataatgctctttgacgcctctgtagcacagcatcataaaaataaagccgccaatggagaacataagtgccgcacaggcataaccgacggttgagtcagaaaaaagcgactgcaacggaataaacgccacggtacaaatcaatagccctatggttgcaccaccctggcggtaagccgcgagctgcgcgcgctcattcgggtttttggtaattgccgggatcatcgcaccatacgagcagttcatcagactgtatgaaagtccaaacatcataaacagcgcggtggcaatcgtcgttttaaccggcaaacaaaaggtggtggcgataaactggagcgttgcaattaacgccgccggaaccgctgcatataaaataaagggacgaaatttgcctttaggcccaatatttttccgcgagtcgagtaaaaatccggtgagcatatcggtaaacgcggtaaaaaacttcgccaccagaaagataatcccgccatagtaagcaggcatccctaattcatcggtataaaatttgaggagatacagagtaccgatgcagagcattaaattcgaaccgacgtcgcccataccataggcgattttttcccgcagattcagttttaatgtcagtggattatggtcagacataatcactccttataacgccccgcagggcgtcgtttattattattacgccgtgcgtttacgggcttctatctcttccacaatgcggacatacatcttctcgttcaggctgtagaagcaacccatcgccacaatggtgactaccgccagtgcgcttgggtagatgaagatcaactggcgtaacccttcaatggtgtggtcagcctgtgcgacgttcggcacatagccaatttgcgtcagcatccagccggggaagaaaccagccagcgcctgagacactttgcgaaagaaggtaaaaccggtgtagaccgttccttccgaacgcacgccggtgcgccactcgccgtactcgacggtgtcggaaaccagcgcccagttcaggctgttaacaaacgctgagccaaagaacgccaggcaggagaacgccacgaagctgaccgaaccgccgccgaagaaatagttgagcagatcgcccagcacccaaatcagcaggccgccgatataaactttcttcttgccaaaacgtctgactgaggcaggcatcaggaatacgccgatgaaaatacagcccatgctgaaaaatcccatatacgacaacaggatgggatcgttaagcacgtactgggtgtaatagacctggatggcgagcttgacgttaaacgcccctaaagtgcagaggttggcaatgcacagaatgaacagcgggcggttacccgcaattgcgcggaaagattgcagcaggcccggcttttgcgccggattagcaggctgggtttcgacataacgctctttcacgcccgagtagcagatccacataaacagcaggccaaacagtgaaaacagcgtggcggcgaagatatagccaagttgctgattaccttcgataagattcataactggcacgaatcccaccgtgcacagcagcaggcccagcgtagcgccgccctgacgccatgccgccagtgaggcgcgttcgttggggtttttggtgatagcgggaaccattgcgccgtaggagcagttcatcatgctgaaaaacagtccgtaaagcataaacagaatagtggccatcaccgttttaccggtgacatcaaacggtgtgccgacaaagttggcgatcgccagtaaggtgaccgggaatgacgcatacagaataaaaggacggaacttaccttttggaccgatcttgcgtcgggaatccaacataatgccggtacccatatcggtaaacgcagtaaagaattttgaaatcaaaaagataatgccgccataggtgcctggcagccccagaacgtcggtataaaacttcaaaagataaagcgtaccgatatccagcaggatgttagaggccaggtcgccaataccgtaagagagtttctctttaaagggcaggcgtaaagttgctggatcttccgttgtgatgtgactcatcgatgttctccctttgcccatgagtttccccacgggcggatgtgattagatgctttttaacgacgcgaacagtgccgcccattcgctatcggcgcgataaaagaccggcggcttgccgatgggcgcattaacggtaacttccccgccccggaacgcttcacccgtccaggcgtggacccagttatcctccggcagatagagcgtccagtcgctacggccttcttcatgcaccggagcgaccagaatgtcgcgacctaacaggtactgatatttcagggtgtaagtgtgcgcatcgtcttcgtaatgcaggaacagcgggcgcataaccggcaggccggacttcgcattcagcgcgacggcctctttcaggtaaggtttcagggtggtgaagacggtggtcatacgggcgaaatgggcgatggtttctgcgtcgccgtcaaactgccagttgtcgccaggacggttaccttcgtgggtgcgcatcatcggcgtgaaggcgctgaaatcgcaccagcgcagcagcagctctttgctgcgcttcatctcaaacagggtggtgtaaccgccaatgtcgctgtggtgcaggccatgtccggtcattgccagcgacagcgccgccgggacaaccgacgccaggccatcgtcgagactccagtcgacgttctggtcgcccgcccacatcatggtggagtatttctggctaccggtagaaccggcgcgcataaagaaaaggatctcgccgagcttgcccgtttcttcaagggcttcgtagttacacttcgcccacagcgcaggccaggcgttatgcataatttcggcactgacgccgttatgcaagtacgtgtcggtgggcagatactcgccgaagtcagccatccagccgccgcagccgagttcaatcatgttctttttgatcacttccttgaaccaggcgtaggcttctggattagtgagatcgacaacgccgccgtaaaactcgccaaactccaccagatagtcaccgccagaggcatcttttgccagatagccgtgttgtgccgcttcttcgcagagatctttatcgctggcaacatacgggttgatataggccaggaactgcacgccctcctgattccactgcttaatgcgtgaatccagttgcgggtagttttcgctgttccacttccagttccacatcacgcgtttgccaaaagaggtcatacgaataccggaccagtcctgcgcccagatgccgttgaccttcacgcccgcgttacgcatggtgtccagtttcttctggcacacttccgtcccgccctgaatgccgagcgttactccgtcataaatccagtcgggcagttctggctggcgtcccagcagggcggttaatttttccagcagggaaatgtatgtgtcagcacattcaaaacgcagcgttgctttgtcttcccacagcgccagttcatggtattccggggcactaaagtcgaagttcatatagcaactgttatcaacatggcagtaatacttctgcgtgctgacaaacgtaggctgtgggaagaaagtccagtaatagtcgccgcccgcattttctttgcagtcggcctgccaggtgacataggtttgtttgttgcgaccaacgccttgttcactggtccatagcgggaacggtttgccacgcagatcgaagtaggaaaactgttcgccgcagccgtagatatggtcctctggttgagcggcaaggcgcagccagatacggttgtggttaaggttgtcgttttgtagttccagcaataaacgcccctgatcgtcggcagagatattcagcgtggcgctaatgtcagaaccacggctgaaatgaattaaccaaccatccggtgactggctgacgatggcgtcggtaagcgcaattttctcctgtagtttatctttaatgctgaaattaccgcggaacatatcgatatccgctatacctgagccaatccataaacaaggattatctttgctatgggttaaaataagacgttgttgaaaatgtagggtaaaactgtcgttattctgatgaaattgaaaatctaataactgtggacgtggcgtatccataactaatctccatagagttgagaacgagattgttgccttcctgttattacaggcttatgtaaaatgattctcataaaactgatatataaaaactttacagaagctgagctgtttttaacttaataaattgaagatacataatgttgcctttagcgagtgaaatgttcttcaatgattttgactgctaatcaatacaagttattttctctgtccgtaaatattaaaaaacaggcggtgcggttttcctgattccagtaataataagtcgatacctgaattaaaggcgttaggcgggcaactcataggttcaactgccagtccctgacgctgtaatttttcaccgctataaacctgcacccagagttgatcggaacaaaggcttaccgaaagcgcctgctgtggatgggtaatggtcatttcccacaaatcattagcggttttaaaggtgtggtcgatttttgtcgcggctatttttttcgcctgcgtgaaatttaaatccagctcatcaacgtggtgaagcgttgtcggattcgcgtgctcatcgacggcataaacctggtttgccggaagctggaacagatattcatcaacagatgttaagttgcaggttaaataaggatgaatacccacgccataaggcgctgcgacagtgccgatattctggcttgcgatctcaacggaaagacccgtgtgtgcgttgagcgaataaacaacttgtgaagccagcataaacggatagccgtaactgggcggcagaaaagctgtcagggtaacgctggtggcggttaattcactaatttgccagtctcgccaggcaagcagcccgtgaatagcggcttttgaactatgttcattaatgggtaactgatattcctgcccctgatagcggtaacagccgttggcgatccggttcggccacggaataagcactttacccagatgcgccagcggcatctcttcgggtttgtgcgggatgactaaatgacaaccctgaaaggttaattcagccagaccagcaccgacggtcacaatggtcgcgtgataatcccccgcggcaagtgaaacggtctgtccactgcaatgcatattggtgatttgcatacaaggcaccttaattaacgacatacagcctcccgtgaggctgatgtcaaacccaaaaactgcaccggacggtcccctcgcccctttggggagagggttagggagaggggaaaacccgcaccctattttcagatcagttatttcgcattaatatccagcagacccgctgcaaccgctggagccatgccgggcgctaacgggatacgcgggatcaccaggcaatgcagcaggtgataaatatcctgtttgccgtcccagactttggtggtgaccttattgtccgcatccagctcctgccaccaggaaccattttcatagtccatcaggtacttaatgcagtactcccaccatgtttgataccaggtttcatactggcgatcgccagtgacggtgtagagcgcgtaggccgtacccattgcttcgacgataggccaacgtacacgttcgcggaccaccggttttccttcccagtcaacggtataaacaatcccgtccgcgccatcgggtgcccaggcatcgcgcacggtggcgttaaacagacctttggcatcttctagcagccatgctggtggttgttcgcaacgggcttccagggcagcatggatgtgcagcattaaacggccccattcgatccagtggcctggtgtacctccgaacgcgcggaagcgatgcgccgggttatctttgttgtaatccggcagcggattccactgggtatcgaagtgttcgttaacgcgataatgattatttctggcgacgtcgtggataatcacggaagccacgcgaatcgcgcgatccagccattttttgtcgtgagtgacgtcataaacaatcaagaaagcttccaccgcgtgcatattggcattgccgccgcggtactcttcggttttgctgaaggcttcgtcccaggattccaggcacatctgctcttcttcgctccagaaatatttctcgataatttcaatggtgtaatcgagcagcttgcgcgcttccgggtgacccgttgtgacggcgctggcggcacccagcagagcaaagaagtgttgatagccctgtttggaggcatccaccacgccctcgtcattcacgcaggcataccagccgccatattttttatcacgcagtgcgccgttcatggctttgataccgtgatcaaccaacgagtaagcgccaggtcgacccatcgccgcagcaacggaataaacgtgcaacatacgagcggtgatccacagatgggtgcccatctcttctttgatttgccctttattgcctaaccagccaaaaccagtcggcactacggaatttttaccaaaatcaaagatgcggtcggtttcctgttccagccaacggttgtggcttagggtgttaaaccatttcattccttttatcctcatcttagcggcgtttagccatcatttcgtcgacgatatcgccaagttgttgtaatttcggtgcgcaaacgtcacgcagcatcagctcgttgtctggtaaaccgacgaccgatgcccagactgcacggcctgccaggaatcccgatgcgcccgccgtcattgccacgcgtacggcacgcgggaacagtttttcgtcgacaccggaagagaggatcacccatggcatattgatatggtcattcagacgttgtgaagcacagagaagctcttgttgcggacctttgccataaagcggcatttcaactttgtagaggtcagcgccactgtcgcccagctctttggcggcatcgatgatcgcttgttcgcgatcgaatttatcgccacgacgcggtgggcggacgactggctcaatgatgcttaccagaccgtgtgagtggcacagttcgttgaactctttcaccatatccagacgttgctgcgcatcttcatcactacgccacagcaccagcagttttaaggctttgccaccgtcttgtttgatctgtagcggattgattttgcggtcaataaccacgctatcgaccggaataccgttgccaggaatgaactcatcggcggcgacaatcatggcgcaacttttggcaatcgcgttttgctcaaccacctggcggtagcagaattgttgatctaccagaatcgccgaggcataaggcgagagggcctttgcagcgttaactttgaaatcagttaaaacgctatcggctaccggagcgggtgccccagccgcggcaaacatcatgcgcatggcttcgcgctgatcgaccgccagcatggcaaaaccgcccgatgcgcgcgtaatgtcgttgatggtgtacttattcattcatttattcctttatccagtcgttacatttttactttggcagtcatcccggcactgacacggacctgttccagaatggcggaccagtcctggcgaccgcgacccgctgcgcgcgcctggctataaacctcccgtgaggcggcccccagcggcattggcacatgcagctggttggcgacatcaagggcgatgccaagatccttatgggcaagatcgatcatgaaggcgggagaaagatctccgctgaggactttgtttggccaggaagtggtgaagtgacctttaccggcggcggtaccgctcatcactttgacggcaacatcgaagggaagattcagggcttcgcacaaaacggcggcttctgccgaaagcgcattgagcgcgatgctcatgtagttgttgatgagcttaacgcggatccccatgcccggaccgccagcgttgatcaactcactgcccatcgccatcaggatcggtgtggcacgttcaacttgttcagcggtgccgccagccagcagtaacagagtaccggtaatggcatttgcagaagtacggcctaccggaacatccatcatgctgaagcctttggcttgcatatcggcaatcaatttatcggtttgcagcggatggatggtggacatatcaatgaccagcgcatcggtagataagccttcgcaaacgccgttttcaccgaacaacacgttgcgcaccagatcgccattcggcaacatggtaatgataaattcggcatctttagcggcctgcgccgggttggcggcgggagtcgcacctttgtctaccagatgccgcacagcttcggcgttcacatcaaagacgcgaagttgatgcccttgctgcaataaattgctcgccattggcgaacccatttgtcctaaaccgataaacgcgattgctgccataaccctctcctgaatacagttatgtcactttttgtcatttatgacatgctttgcttgtctgtttttgatcgtatttgtaatttatcgtcaaaaaattgacagccgtcactttttaaacaattggtgaaattaaaatgaacgcatcccaaaatgtttaaggaatgaccatgattcgtgttgcttgtgtaggtataaccgtgatggatcgcatctattacgtggaagggttaccgacggagagcggtaaatacgtggcgagaaattatacggaagttggtggcgggccagcggcgacggcagcggttgcggcggcaaggctgggggcgcaggtcgattttattggtcgcgtaggtgatgacgacacgggcaacagcctgctggcagagctggaatcctggggcgttaacacccgttacaccaaacggtataaccaggcgaaatcttcgcaatccgccatcatggtggataccaaaggcgagcggataatcattaactaccccagcccggatctgctgcctgacgcagagtggttggaggaaattgatttctctcagtgggatgttgtgctggcagatgtacgctggcacgacggcgctaaaaaagccttcaccctggcccgtcaggcgggtgtgatgaccgttctggacggggacattacgccgcaggatatcagtgagctggtggcattaagcgatcacgcggccttttcagaaccgggtctggcgcgcttaacgggcgtgaaagagatggccagtgcgctaaaacaggcacaaacgctcacaaatggtcatgtctatgtgacccagggtagcgcaggctgcgactggctggaaaatggtgggcgtcagcatcaaccggccttcaaagttgatgtggtagataccacaggtgcgggtgatgtttttcacggcgctttggcggtggcgctggcaacaagtggggatttagcggagtcagtccgcttcgccagcggtgtagcggcgttaaaatgcacacgtcccggtggacgagccgggatccctgactgtgatcaaacccgatcttttttgtcactttttgtataaaatgccagggtgatggtttttcgaggaattttcatgagccttaccgaactaaccggtaacccgcggcacgaccaactcctcatgctgatcgccgagcgtgggtatatgaatattgatgagctggcaaatctgctggatgtctccacgcagacggtccgccgggatattcgtaaattaagcgagcaaggcctgattacgcgccatcacggtggcgcgggtcgggcttccagcgtcgttaatacggcgttcgagcagcgtgaggtttcgcaaaccgaggaaaaaaaagcgattgccgaagcggtggcagactatattcctgatggttcaacaatatttatcaccattggtacgactgttgagcatgttgcccgggcgttacttaaccataatcatttgcggataatcaccaacagcctgcgtgtggcgcatattctttaccacaacccgcgctttgaagtgatggtgcccggcggtacgttgcgctctcataatagcgggatcattggcccttcagcggcgtcctttgtggctgattttcgtgctgattatctggtaacaagcgttggggcgattgagagcgatggcgcgttgatggagtttgatgtaaacgaagctaacgtggtgaaaacgatgatggcgcacgcgagaaatattctgctggtcgccgatcacactaagtatcatgcttcggcggcggttgaaattggtaacgtggcacaggtcactgcgctctttaccgacgagctgccgcccgctgcgctaaaatcacgcttacaagacagccaaattgaaatcattcttccccaggaagacgcgtagatttttgtgaccgttaacctggcttcataccttgccacatagccaaacccatcctttcccgctacagttaatttcttgtggcgcgaaaggaggcaaaaatgctctatatctttgatttaggtaatgtgattgtcgatatcgactttaaccgtgtgctgggagcctggagcgatttaacgcgtattccgctggcatcgcttaagaagagttttcatatgggggaggcgtttcatcagcatgagcgtggggaaattagcgacgaagcgttcgcagaggcgctgtgtcatgagatggctctaccgctaagctacgagcagttctctcacggctggcaggcggtgtttgttgcgctgcgcccggaagtgatcgccatcatgcataaactgcgtgagcaggggcatcgcgtggtggtgctttccaataccaaccgcctgcataccaccttctggccggaagaatacccggaaattcgtgatgctgctgaccatatctatctgtcgcaagatctggggatgcgcaaacctgaagcacgaatttaccagcatgttttgcaggcggaaggtttttcacccagcgatacggtctttttcgacgataacgccgataatatagaaggagccaatcagctgggcattaccagtattctggtgaaagataaaaccaccatcccggactatttcgcgaaggtgttatgctaaaaaccattcaggacaaagccaggcaccgtacccgtccactatgggcctggctaaaactactctggcaacgcattgatgaggacaacatgacaaccctggcaggtaaccttgcctatgtgtcgttgctctcattagtgccgctggttgccgttgtttttgcgcttttcgccgcttttcccatgttttccgacgtcagcattcagttacgtcactttatttttgccaactttctgcctgctactggcgatgttattcagcggtatatcgaacaatttgttgccaattccaacaagatgaccgccgttggggcgtgcgggctgatcgtcaccgcgttattgttgatgtactccatcgatagcgcgttgaataccatctggcgcagtaaacgagcgcgaccaaaaatttactcgttcgccgtgtactggatgattttaacgctggggccgctgctggcaggggccagtctggcgatcagttcctatttgctctccctgcgctgggcgagcgatctcaatactgtcatcgacaacgtgctgcgtatttttccgttgctgttgtcgtggatctccttctggttgctgtacagcattgttcctaccatccgcgtacctaaccgcgacgcgattgtcggcgcgtttgtcgccgcactcctgttcgaagcaggaaagaaaggtttcgcgctttatatcaccatgttcccgtcatatcagctcatttatggtgtgctggcggtgatccccattctctttgtttgggtctactggacatggtgtatcgtcttgcttggcgcggaaattactgtcactctcggggaataccgcaaactaaaacaagcagctgaacaagaagaagacgacgaaccatgattgcattaattcaacgcgtaacccgtgccagcgtcaccgtggagggagaagtgacgggcgaaattggcgcgggacttttggtgttattgggtgtcgaaaaggatgacgacgaacagaaagcaaaccgtctgtgcgagcgtgtgctcggctaccgcatctttagcgatgccgaaggcaagatgaatctcaacgtgcaacaggcgggcggcagtgtgctggtggtttcccagtttaccctcgccgcagataccgaacgggggatgcgcccaagtttctccaaaggtgcatcaccggatcgcgcagaggcgttatatgactatttcgtcgaacgctgccgtcagcaagagatgaacacgcaaacaggacgcttcgctgcggatatgcaggtatcgctggtcaatgatggccccgtgacattctggttgcaggtatgagccagcttccagggttgtcacgggaaacaagagagagtatcgctatgtatcaccttcgggttccacaaacagaagaagaattagagcgttactatcagtttcgctgggaaatgttgcgtaagcccctgcatcaaccaaaaggttcggaacgcgacgcgtgggatgcgatggcgcatcaccagatggtcgtcgacgagcagggtaatctggtggcggtaggccgactgtatattaatgccgacaatgaagcgtccattcgctttatggccgttcatcccgacgtgcaggacaaagggttaggcacgctgatggcgatgaccctggagtcggtggcgcgtcaggaaggcgttaagcgcgtgacctgtagcgcccgtgaagacgcggtggagtttttcgccaagctggggtttgttaatcagggagaaatcaccacgccaaccaccacgccgattcgccattttttgatgattaagcccgtcgccactctggatgacattctgcatcgcggcgactggtgcgcgcagctgcaacaggcgtggtacgaacatatcccgcttagtgaaaaaatgggcgtgcgcattcagcaatataccgggcaaaaatttatcactaccatgccagaaaccggcaatcagaatccgcaccatacgctgtttgccgggagtttattctcactggcgacgctcactggttggggacttatctggctgatgctgcgtgaacgccacctcggcggaacgattattcttgcggatgcgcatatccgctacagcaagccgattagcggtaaacctcatgcggtagccgacctcggtgccttaagcggcgatctcgaccgtctggcgcgcggacgaaaagcacgggtgcagatgcaggtcgaaatctttggcgacgagacgccgggtgcagtgtttgaaggcacgtatatcgttctgcccgcgaagccatttggcccgtatgaagagggcgggaacgaagaagagtagctgatggagaggggcggtgctgcctctctcattcaggtcatttatattagtccttggctatttcggttatattaaataagaactctataaatttttattcttcgttggctccatacgtgtcttgctacatcactgttcaggagcatttaaatattatttgtagaactgagtggcaattatcgcagataatgcttaattcatcatcttagttcatgtttgagcgatttttgatagtcaaaaccccctctggtgccatacttttctcataaatatttttaaaatctatagctaacaaatattatgcaaagataatggactagcatcattgtcagtatcattcatttactgctctgtatgttatgaataattatgttgtatgtttgctcttaaaccgtgggaaggaggctataatggttgccaatattaatctcattaaacaagaaagttattctgttgttaatttagaaaaacaactttcccgaactgttaccaacaaaattataacgatgagcaagtaaagaccggttggtggcagtactgaccggtctgtgatgaaagattaatttcaccttaaatcctggtgctgttaggatgctgacgtttttcggctacaccattcagattatgcaaataaatatctctgaatataatatattcatagcacccataattcatcctgggcgataactaaaccatttttgagtaataaatgaaacaactgcaacactcttattatttctggaaaacgcctcgcaaaaacaaaacaacatgcaaaaatccgctttttttaaatgattttccggcgtaattttcgcacatacattaatgagtaatatatgtaaggtattggtaatggcgatgaatacggtttttcttcatttatcagaagaggcaattaaacggctgaacaagcttcggggctggcgtaaggtttcacgatctgcaattttacgcgaagcggtagagcaatatctggaacgtcagcaattcccggtgcgtaaagcaaagggaggcaggcaaaagggggaggtagttggtgttgatgatcagtgtaaggagcataaggaatgacaaaaatttttcattcttgaatataaaaaacagatgcccttattctggtattaatacaaggctgttttacttgaacttataataactgcaactgttacatcatatctggaaaacgcctcgcaaaaataaaaaatgatgcgtaaatgagctttctttaaagattcggcaagggtacttttctctccatagattcaaaaatgatattggcgagatatttatgaactctctggcaggtatagatatgggcagaattttactcgatttatcgaatgaggtgattaagcaacttgatgatctcgaggtgcagcgtaatcttcctcgtgcggacctattaagggaagcggtagatcaatacctgataaatcaatcgcaaacagcaagaaccagtgttcctggcatctggcaagggtgtgaggaagatggtgtcgaatatcagcgtaagctgcgcgaggaatggtaatgggaaaaaatgatgtcaatcagattgctgacaacgtgcgcgttgttcatgccggatgcggcgtgaacgccttatccggcctacaaagtcgtataaattcaatgtattgcagtttattggtaggcctgataagcgcagcgcatcaggcaatcttacgcttgtcatcagtctcatgcccataaccttattgatgtggtggtgggtaaattgaggccaaaccggcactggcggcatagcttgaggtggtaacgcggaatacgagagatggtgtcgtcacaccctatgagctgtaatccgggcgacctgcgccacccggaaaacgtcagagattactctccttcacccggaaacaggaacgggttgatggaactgcgggcatagccttcttgctccattcgtgcgtccagtaccagagaggcgaggtcatctgctacggcttcgatttttggatctttttcctgatagagaattttcaggtaagtgtcgcagtcatcgcagctttcggctttaatcgcggcctgttcgtcatccagcgaccagtaatgcagtttgccgctctgctcgcagttgctgcattttacgcgcactacgtgccattcagtttcacacaggttgcagtgcaggtaacgtagcccctgagtggtgccaatttgcaccatgctggacaccggcatagaaccacaaaccgggcaatattgacgttgctcgccgtattcagcgcgggctttgccggggatcagattggccatctgcgcccagtagagcgacagtgcagcccagataaacggcgctttatcgctgctgacggacgagaaatcagaggcaaacagcgcgctggccatatcttccagctcctgagtcgatgccttctccagattctcaatcactgccagcgccgggccgctcatttcaggtttcagctcagcaatcagcgccatcagcagcttttgccagtgcttatcacgcggcagaacgtgaatatccagcgggggcttgccttgtgcgctggcttctttaatgcgcgcagtcagatccatctccagcggatggtcgtacagcaccacttcctgggcgtgggcgataagcgcagcaaagcgcaggtaatcacccagaggattattttctgccagctcgcgcagacgctcggcgcggcggttgtataaattcttgagccgagggaacaataacggcggaatcatatccgccgtacgtttctcgcttgaacccagctcatcttgcgggattatgcgaatactcattcagctttcttttccgttgtcttgcggacctcacggtaccagcgcgggtgatgtttcttcgcccaggcgctggtaacccatccttccaccatggcggtaatcgtgcctttcacccaaagggcggcgtagatatgcaccatgataaccacaattaacgccactgcggcaaatgaatgcagcattaacgcgaatcggatcaccgggattgagaaagcaggcgcaaaataaggacgccagataatcacgccgctcaccagcagcagaaccaggaaaataatcgccgcccagaaaacgcatttctgaccgaagttataacgcccggtgtcacctacttcctcgttgacgacgatcttacgaatattcttcgcccaaaagatatcatcccgattgattaggttgtgatgccagtaacggaaaaacatgatgatgaacgaggcaaacataaccacgccgacaaacgggtgcagaattcgcgccagctgcggtgtgcccatgatttgcatcaaccagttgaaggacgggaacaaaaagcccagcccgctcaccgccgccaggatgaagcagaaggcggtgatccagtggttgatacgttccggcgcggtgtagcgcacgatggtgtcacgtcgtttcatttgcgctcctcgtctttctcttcgtgcagattattctcttcctcatccgcacggttcggaccgacacccacgtagtggaagatactggccgcaaaggtagccgcaaagccaacagccgcgagcggtttccagatgcctttccagaatttcacggtttcgctgatttccgggttctccggcaagccatgatacagatttggcttgtcagcatggtgcagcacgtacatgacgtgtgtaccaccgacgcctgccggatcgtacagacccgcattgtcgtaaccgcgggttttcagctcagcaacgcgctcgctcgccagcgttttcatcgactctttcgtaccgaagtgaatcgcgcccgttgggcaggtcttcacgcaggctggttcttgcccaaccaccacgcggtcaacgcacagcgtacatttgtagacgcggttgtcttccgggttgaggcgcggaatgtcgaacggacagcccgcaatgcaataaccgcagccaatgcactgctcggactggaagtcgacgataccgttggcatactgaataattgcaccttccgccgggcacgctttcaggcagcctggatcggaacagtgcatacagccgtctttgcggatcagccattccagtttgtcgttctgctccacttccgagaagcgcattaccgtccacgatttggcgcttaaatcattggggttgtcgtacaccccaatgttattgccgacggtatcgcgaatgtcgttccactctgaacacgccacctgacaggctttacagccgatacaggtggtaacgtcgatgagtttcgccacttcttcctggaagtcccgcgcctgaggcgcgggggtcagaccgttagtcgcggaacgacgaatgatatcttgagattgataagccatatgtcgtctccgttacaccttttccacattcacaaggaaggacttaaactccggcgtctgcgtgttcgcatcaccaacgaatggcgttaaagtattggcaataaagccttttttagctacgccttcatagccccagtgaatcggaataccgatggtatcgatatctttgccgttcgctttcagcgtgcgaatacgtttggtcaccaccgctttggctttgatatagccacggttggaggagactttcacggtatcgccctgggcaatgccaagtttattcgccagcgactccccgatttccacaaactgctctggctgcaaaatcgcgttcaacagcgcgtgtttggtccagtagtggaagtgctcggtcagacgataggtggttccgacatacgggaacttatcggctttacccaatgcttcggcgtcgtctttaaagatacgtgcagccgggttcgagataacgtttggatgcagcgggttagttcccagcggcgtttcaaacggctcgtagtgttccgggaacggaccttccgccatcttatcgagggcaaacagacgccccatgccttcctgctgcatgataaacggcccgacgccgctacccggaggcgctgcgctgtagtccggaatatcccagccggtccacttagtgccgtcccatttcagcaactgacgcttcggatcccacgggttaccctgcggatctgcggaggcgcggttatacagaatgcggcggttaagcggccatgcccatgcccagcccagcgtgttaccgaggccagacggatcggcgttatcacggcgtgccatctggttgccttccggcgtccagctaccggcgaaaatccagcagccacaggaggttgtaccgtcatcgcgcaattgggcgaacgaactaagttgttggcctttcttgacgataaccgcaccggttgccggatcggtaatatcggccagcgccttaccgttgctctccatcgccacttcttctgaagatggctcatgcggaatggcgtagttccatgtcatgttcagcacctggtccgggttcgcgccaccctgttcggcatacatcttgcgcaagcgcaggaagataccggagaggatctcgccgtcagtcagcgcaatccccggggcgtccgcacctttccagtgccactgtaaccagcgacctgagttaacgatagaaccgttctcttccgcgaagcaggtcgatggcagacggaacacttcggtctggatcttcgacgagtcaacttcgttcagctcaccgtggttctgccagaagttagaggtttcagtgttcagtgggtcgatggtgacgaggaacttcagtttcgacagacaaccgatcactttgtttttgttcgggaatgaggcaacagggttaaagccctggcagatatagccattgaccttgccctctttcatcatctcgaagtattgcaggacgtcgtagcctttatcccacttcggcaaccagtcaaagccccagctattttccgccgtcgctttatcaccaaagaaggccttcatcatagagacgaagaatttcgggtagttgccccagtagtttacctggccttccagcagcggttttggcgtgttggcggtaaggtaggtttgcagatcggtctgcttctcgcttggcagcgtcatgtaacctggcaggctctgcgacagcagccccaggtccgtcagcccctgaatattggagtgaccgcgcagggcgttaacgccgccgcctgccatccccatattgccgagcagcagctggatcatcgccatcgtacgaatgttttgcgcaccaacggagtgttgcgtccagccgagggcatacaggaacgaggcagttttatcgtgagcactggtttctgcgatgtattcgcagactttcaggaacgcgtcttttggcgtaccacagatgttttcaaccacatctggcgtgtagcgggaaacgtgctgtttcagcaagttccacacgcagcgcggatgttgcagcgtggtatcgcgtttggcgaagccgttttcgtccagttcataagtccaggaggatttatcgtacttgcgtttttccgcgtcgtagccggtgaacaggccatcttcaaagccgtaatcctcacgcacgatcaggctggcgttggtataggcttcggtgtattcgcggttgaatttttcattgttcagcaggtacagcaatacgcctgacaggaaagcaatgtcagtaccggaacgaataggggcatagtagtcagctaccgccgccgtacgcgtaaagcgaggatcgatcacaatcagcttcgcgccgttgtgaattttggcttccatcgcccagcggaacccgaccgggtgagcttcagcggcgttaccgcccatcaccacgacgaggttggcgttcttgatgtcgacccagtggttggtcatcgcaccgcgaccaaatgttggagcaagacttgctaccgttggtccgtgtcagacacgcgcctggttgtcgaccgcgagcatacccagcgcgcgggagaatttttgcgttaaatagccggtttcgttactcgacgcggaagcacacagcatcccggtggagagccagcggttaacagtcacgccttcggcgttttgcgcaatgtagttagcatcgcggtcttctttcatcagtttggcgatgcgatcaaacgcctcttcccaactgatttgctgccatttatcagaacctggcgcacggtattccggaaacttcagacggctttcggagtggatgaaatccaccaggccagcgcctttcggacaaagtgcaccgcggttgaccgggtgatccggatcgccttcgatatggaagatagatgctttggcgttttttgctccgtcaccgaggctgtacatcaacagcccacagcctacggaacaataggtgcaggtattacgggtttcgcgggtgcgcagcagtttatactgccgggtttccgcgagtgctacgctgggtgcaaaacccagtgccgctgccgtggtgcctgccataccgccagcgcagatcttaaagaactgccttctgctgacctgcatggattgctccttgtttcgacattgtcacgtcccatttacattcgcttgctgcgtgtgcagggagtgggagttatttttctttgcggaaggggccgcaaaggtccagaattggctcaatttccctccatccaggaagggtttgtaacagaataccataatgttggtgtgtgtgttcttatctggttaagagaaagtgaaaaaaacacagcgaaaagaaatcgaaaatgtgacaaatatcacaggtgttcgtcaaattgagttatggcggcgtgatgatttacaacacccacggttagatgaggtcgcggaagaagttcccgttgcgctggtctacaacggcatttcgcatgtggtgatgatggcgtcgcccaaagaccttgagtactttgcgctcggtttttcgctttccgaggggattatcgaaagtccgcgcgatatcttcggcatggatgtcgttccttcctgtaatggtcttgaagtacaaattgagctttccagccgccgctttatggggttgaaggagcgccgccgggcgctggcgggacgtacgggctgtggcgtatgcggcgtggagcaacttaatgacatcggaaaaccggtgcagccgctaccgttcacccagacgtttgatctcaacaaactggatgatgcattacgtcatctcaacgattttcagccagtggggcaactgactggttgtactcacgccgctgcctggatgttgccatctggcgaactggtcggcgggcatgaagacgtgggtcgccatgtggcgctggacaaactgttaggccgccggtcacaagaaggggaaagctggcagcaaggtgcggtactggtttccagtcgtgccagttatgaaatggtgcaaaagtcggcgatgtgcggcgtagagattttgtttgcggtgtctgccgcgaccacgcttgctgtagaagtggctgagcgctgtaatctgacactggtaggtttttgtaaaccgggtcgggcaacggtttatacccatccgcagcgtttgagcaattaattaaaataagtcctgcgaaatatattaaattgcaggacttattcatttcgtgaattttattattttatttataaacaaaatgcgtgtagtggcgttttcttttttcatttattatgttcactctcttatctatatatttataaggcaattaaatgaaaaggaatttattatcttccgctattatagtcgccatcatgtccctcggtctgacgggttgtgatgataaaaaagccgaaacagaaacgctcccgcctgccaatagtcaacctgccgcaccagctcctgaagcgaaacctactgaagctcccgttgcaaaagcagaagctaaacctgaaacacctgcgcaaccggtggtcgatgaacaagcggttttcgacgaaaaaatggatgtctatatcaagtgctacaacaagttacagatcccggtacagcgcagtctggcgcgttatgctgactggctgaaagattttaaacaggggcctaccggtgaagagcgtactgtttatggcatctacggcattagtgaatccaacctcgctgagtgtgaaaaaggcgtaaaaagtgctgtggcgttaacgcctgcgctgcaaccaattgatggcgtggcggtgagttatatcgatgctgccgtggcgttgggtaataccattaacgaaatggataaatattacacccaggaaaattataaagacgatgcgtttgcgaaagggaaaacgctgcaccagacattcttaaaaaatctggaagcctttgaacctgtagccgaatcttatcatgcggcgattcaggaaattaatgataagcgtcagcttgcggaactgaaaaatattgaagaaagagaagggaaaacattccactactactctctggcagtcatgatttcagcgaaacaaattaataacctgatatcgcaagataagtttgatgcagaagcggcaatgaagaaagtgtctgaactggaaacgctagtggcgcaggccaaagaagcggataaaggcggcatgaatttctcgtttattaattcggcaggccagtatcaactcgaggctaaaaaatacgttcgccgcatcagagataaagtcccgtactctgactgggataaagagcaacttcaggacgcaaactcaagctggatggtcgaagactctttcccgagagcattacgcgagtacaacgaaatggttgatgactataatagcctgcgttaaacgtttttgatgataaatgcagtgtcggatgcggcgcatccgacacagttcaccccttgtgaagtaactccataaatgcctcatatcctgttaacccggcaataatctccgccggatgctgacacaatatgcttgccagatagctaaatatttttagctcatgacgcgcatcggcggcggcgcaggcgatcaagacatggttaatgacttcgttattcacctcaactggttgggcgagggtaataaaaaatccacgaaaacgtcgctcctgttcgctccagcaatgtgggatggcgaggcgattaacaatcaggttttcaccttcgccttcgcgggcgatgatgcgttgtgcttcatcggcggtaatatggtgttgtgcgactaattgcgcacaaatttgccgggtaatatgttgccagctttcaccgcgtacattcgaataatgaaaacttccgggggcagagaaaaaacgctccggctgttggcgaataaatgccgtcgccagaaaatgttttatttgttcgataccggcagccgtaatgatattttttacggtgatgtaattatttaccgcgtcatccagtaaataatggctgttgttaatgatcaataacggctcaatctcttcgcgaatggcaacaagttcgcttaagctacgggcaataattacccgacaatttaaaacatcgcgctcaatggcgagctgattaatagtggcaatcgcgttctggtccgagagcaaaatgatcggctggcgttcgttttgatgccgctccagcgcacaggcaaaatacaaaccgatcagatcgctgtcgaaaaggggaatatcgagctgttcacgcagtagcgtaataaagtgcagactcatatcaaaggccgcaggccaggcggctttcaggttattcatgctgctctggcggtgctcagcaatccacactggtgcggcaaggcaacgtaataaatgcccggtaatattctcaaccagctgcgcatcaataatattcaatgacgcgatgcccggcaccctttgcagcaacccctgcacattatcggctgaaattacctgcgcttgctgatgctgtttctctatcaaacccgtcagggttcttacagcgttatcaccaagaaacagaccgctatgttcaacgatttgttttatctcgtcaccgggatattgcggccactcatcggtcagttgattacgcagggcgtaaatcgccagaatcaggctggagagataatcaccctgcatgagcggccagcggtgttggttgtcgcaggccgtggataaatgctgaaggttgtctcgtgttatgcccgccagcggaattaaaaacggatctttgcgcagcaagttcgccagcaagataacgcgtttctcttctgtctcatcaatgaaatggcccaaaccagggcggctggccaggcaacaagtgcgttcataacgctgttttaaccggggcagacgctctgctacccacgtttctggcaaattaagcgccgaggcgagttgcgcacggggagtgaaagtattcagtaataacagcgccagcagccgatcgtcgttatcgtgcttttgcagcaactgaaaaaagctgcggcgctcgaagatttccagctgatagcccgcactgccactggcgaaaatgcgggctttgccgttaagggtgaagttgagatagtcaatatcacgcaggatggtcctgcctgaaacgccagtctgttgcgccagctcgccaggcgtgcgcggctgttgctccagcagatcgacaatctttaactggcgttcgtttagcattaatccacctgacggaactggctaaacgcgttgactttctccgcagttaaggtcgtcagaaaaccccgtatcagcgtgagcagagcttcgtaatcggcttttgaaatcataccgctgttggcgtgcagataacgagttggcagacacagcgcgacaaccggacgcccgccgcccatcacgttgtagcgcccgccatccgtcgcaccggttttcatggtggaaaattgcagcggtaaatcgttatgtgcggcacagctttttaacgctgctaccagtttctggttggggaagtagcgcttgtcaaacagcatcagccccggcccctggcccagtttcagcgggtatttaatgttatcaatgcccggaacatcgcccgctacggcggtatccaacacgatcacgacgtccggtttaatgtgttccgccgaggtttgcgccccgcgtagcccaacttcttcttccacactgccaacgccatacagcgtaatttcgggattattcaccgtctgcaatagttcagccatcattgcgcagccgatgcggttatccaacgccttgccgaccactttatcttcgccccagcaggcaaaattggcttccgggctaataaaattaccaatttccacgccgcgcttttccacctcttcgcgactgttcgcgccaatatcaatgaacatctcatcaaatgacagcggttgttgcttttgcttttccgttaacgcatgaggcgcgacggaaccaatcacaccagggattttcactcccttgtgtgtgcgtatggttacccggtggttgagcatcgactgattccaccagccgccaatggtggtaaaacgcagaaaaccgctctcgtcgatgtgggtgaccataaagccgacttcatccatatgtccgacaacggcaacttttggacctttattccccttacgggcaacaaagctgcccagaccatcgaaggtgatttcattcacgcaaggttccagcgtgtttatcagaatgtcgcgaacttcctgttcatcgccgctgacggcgctggcttcgcacaactgttgcagtaactcaatgttcatggacaagctcctgttgcgcggctttcgctttgcggcgtaaccacaatcctttcaggacgataatgaatgaaatgttcagcgcgaggccaatcgccagcaccagataaaacgaacccaccggcgacatcaggccgatcagcgggtcaaagatacccaaaccaggtgccagacgtttgattccgaaagcgatcaccagcacgccggtaatgccgcccgccagcgtattggcggtaatcatcggcaacggagctgccagagcgtaaggaatagccggttcggttgcgactgtggcaccgaccacaatggcactactggcagcctctttttcctgtcgggtaaacagtttgggcgcaatgaacgtcgcaagacccgccgcgacgggcggcatcagcgcgacaacgccgacgatggcgtaccagtcataaatgtgtttttccagcagtgagaagcagaagaaccaggcggttttattgatggggccgcccatatcgaacgccagcatcgcaccgaccagaaacgctgccgcaaacttcattgatggaggaatggtattcaggaagtggagcagcccgcccatgaggtcggacatcaccggcccgataacgtagtaagtgagcacgccgaaaaccagcagagtaacgaacgggatcagcattgaaccgagcagcggttgtaatgctttgccaaggcgcactttgcggaaccagaagacgaaatagccaatcgccagccccagcaccaccgcgccgaggaatcccgcacccgactgggtgccgagcagcgctttgtcgttcgccagatagcaaaccagaaacgccggagcgaaagccggtttatcggcaatcgacgaggcaatataagcgcccatgatggggatcataaaggtgaagccaaggtaaccgatggattcaactacccaggtaaacgacggcgcgcctttcgacatatcggtatacggcaaaccgaactgcaccagcatgttggcaagcgccaccaggataccaccgccgatgacaaacggcagcgccgcagagacgcccgccatcaggtggctcatcacgctaccgctttgcacttcctgtttgccaagcttcacgccgctatctgcggcaaaaagctgcgagtttgtcggtaattcgctgaaaatctggtcgatatttttcaacgcctgggagatggcaatctcataaactttcttcccggcaaaccgcgcgcgatcatcaccgctcaggccacgcccggtagcgagaatgacgtaatcggcagcggcaatctcttcgctggataagcggttttcaacgccactggacccttgagtttccacttttatggtatgaccgagagaacgggctttctgttccagggcttccgccaccatgtaggtgtgagcgatcccggcggggcagttggtgatcgcgacaatacgtaaggatgactccatcgccacttccttatgagctgagggtttgatttaacaaggcaagcacctggtcggtatcgccctgttgcagttgatgaataaattccttgtgaataattttgcgacacagtgtgccgatgattttgacctgatcctcttcgccgctttgcggcacgccgaggcagatccagcaattgacgtcttcgccatcgctggctttccagtcaatagcctgcgctttgcgggcgaataatacgaacggttgtttaacgcaggcgcttttaccgtgcggcacggcgacaccggaaccaaatccagtagagtgcattttttcgcgcagcagcagggtttgcaggaactggtgtgagtcggtgataaaaccgttttgtaacgctattgtcgccaactgcttcagaacggaataagcgccattgccctgaatattcaggtcaatacagcttgcagtaagagctgccattaatcggactccataaaatatattttaatcaattgtaatggtggagcgattaagtgatgagaggcgatatgtcggtaaacaatgacaatttgagacagagtgaaaggtcagatttgcggagtaatgcacataatggttatttaaataaaccacatgaatcattaatgggttattcattatttttgtgatttactcacaatgtatcagggaaatataacttaccgggagatgtaatatgtttaatttttcaaatcgaaatttaaaatattgtgccggaggcatctctggcacattgggcaattacggcaggtaaaacacttcttgcagctcgctactcaccgggctgttatccgggttagcgggcataacatcggtcatatatttccaccaacgttggcaaacatcagtgctggcaaccgcattccagcgttcttcagattcaatctctaccatggcaaacagcagattacgcgctttgtcgagatagatggcgtagttatgcgcaccgtgagatttcagcactgcttccagttctggccagatgggattatgccgacgctgatactcttcgtgggcgtcggggtttacctgcatgacaaaggctttgcggatcatgtttgctccttacagcgccagcgcactggcgagtggcgtaacgccgaaacgcttgccgagcgctatcaactcttcacggctgatggtctgtttcatgccgcccatcgaataaaccttcactaatacttgtgctgatttttctgcggtgtcgattaaaccgaaggtttcatccagcgtcggtccgctgccgaagacgccgtggaagggccacaacaccagcgaatgtttttgcatctcttgtgcggtcgcctggccgatttcgtccgtgccgggcaccatccacggcaaaatgccaacgccatccgggaataccaccagacactcggtgctgccttcccacagttggcgagtgaagaccgcggtgtcgttttcaagtacataggtgagggcgatcaggttggtggcgtggcagtgcatgatcacccgatctttgccgttggtggctttaatgcgctcgcagtgggaaaggaagtgagccggaagttcggaagtggggacggcttcgttggttaacccccaaagaatgtggtagcccgcgccgtcgctgtcgacttttacgatgcctaagttagccgcaggatcaagctggacgttacggaagaatttgcccgagccggtgacaataaacggtgtatttgccagtaaaggcatgggctggctgagcgggatatagcgcggttgttggtggaaattgtcgtgatatggtgcgatatcggcgtcatccaggcgtagcgtcaggttgccgccgttgcgctcatcccagcctttcagccaggcgtcggtggtggctttgatcattccctggacaaaccaggactgagtaatgttttgcatgttctgtgttcctgtaaattcggtgttgtcggatgcacgacccgtaggccggataaggcgctcgcgccgcatccggcaatcaatgcctgatgcgacgctgtcgcgtcttatcaggcctacaactattgccgacctgtaggcctgataaggcacttgtgccgcatccggcaatcaatgcctgatgcgacgctgtcgcgtcttatcaggcctacaactgttgccgacctgtaggccggataaggcacttgtgccgcatccggcaatcaatgcctgatgcgacgctgtcgcgtcttatcaggcctacaactattgccgacctgtaggccggataaggcacttgtgccgcatccggcaatcaatgcctgatgcgacgctgtcgcgtcttatcaggcctacaactgttgccgacccgtaggccggataaggcgctcgcgccgcatccggcagtgtttacccgcggcgactcaaaatttctttctcataagcccgcacgctctccagccattcgctacctgctggcgtatcgtgacgttggcaatacatttcccagaccgcctgccacggcaacgatttctgctcttccagcagtgccagacgcgcagtgtaatcgcccgccgcttccagcttgcgcagctcagcggtaggttccagcaacgcacgcagcagggcttttttcatattgcgtgtaccaatgacccacgcggcaatgcggttgatagaggcatcgaagaagtcaaggccgatatgcacccggtcaaacagatcgtgacgcacaatctcactggcaattgcctgggtttcatcatccagcagcactacgtgatcgctgtcccagcgaaccggacggctgacgtgcagcagcaactgcggcacatacagcatggcggcggaaatcttgtcggaaatcacttcagtcgggtggaagtgcccggcgtccaggcacagcgcagtctggcggctggtggcataccccatgtaaaactcattggagccaaccgtgtagctctctgcgccaatgccaaacaatttgctctcaacggcgtcgatatggtgcgcagggtttagcttctcgctgatcacctcatccagtgctgccagcagacgctgacgcggggcgagacggtcaacggtgatatctttcataccatccgggatccagatgttcatcaccgatggtgtgccgagttgctcgccaaaataggccgaaacgcgacggctggctttgcagtgatcaatccagaactggcgaatgctgtcgtcggcatgggaaagcgtaaagccatcggcgcttagcggatgcgaaaagcaggaggggttaaaatccagaccgagctgattggctttcgcccattcaacccagtttttgaagtgctctggtttgatctggtcgcgcgagactggcgtatctgattccagatagatggcatgtaaattaagccgtttcggccccggaatcagccgcatagcctgttccagatcggcacgtagctcactggcattacgcgctttgcccggataattgcctgtggcctgaatccccccggtcagcgaaccttccgggttttcaaaaccggaaacatcatcgccctgccagcagtgcattgaaacgggtaaacgatcaagttggcgcagcgcctcctcgacatcaatccccaccgccgcgaaacgctgtttcgctagctcccaggcctgttccagttgagtggtcatgcgcaaagctcctttgtctgtcgtgtagagtgaatctgcgccacatagtgggcaatttcactgtcaggattaggggtaaaggtggtcagattcgcggtggtgctgacgacctgacggaaatcatccacattgttgagttcatccagcgtcattaactggatgccgatattgccgagcgtcgaggcttcaacaggcccggcgatcacccgaataccgcaggcatcggcgcatagctggttgagcagcgtgttctggcagcctccgccgacaatatgcagttgcgagaaatcttcaccgcgcagctgcgccagctcatgcaacacatcggcatacagcagcgccagactgtcgaaaatgcagcgcgccagttcagcatcactttccgggatcggttgcgccgtttcccgacacgcagcctgaatttcgctgcacatcgtctcaggattaataaagcgatcgtcattgggattgataatgaagcggcaagccggaagtgcctgtgtcgcggagataagcgccggaagatcgttgatttgctgctcctgaagcactcgctgaagcagccataagcccataatatttttcagcacccgatagcgaccttccgccccgccttcattggtgatgttggctgccagtgccgtgtcattggtaaatggcgtctggctttcgaagcccatcaatgaccaggtgccagaagagagataagcagcacgtgagccgtttaacggcgaggcgataaccgcgctggcggtatcatggctggcaacggcgaccactggaatctcattaccctgcgggcaaatccagtgacctatgacattacccggatgcgtcgggcgaccaaaccaggctttgttggccccgctccacgccagtagcgactcgtcccagtcgtcgctattgatattgaccagttgcgtggtcgtggcgttggtatattcccagttcatcttgccggtcaggcgataactgaagtaatccggcatcagcagagcgtgagcaatgtgtggaataagttcaggttgttgctccgtcagcgcacgcaactgataaagcgtattgaagggcagaaactggatgccgctacgttgataaatatcgcgtttgccgagttgttgttgtgcctgcgccattaggccattggtgcggctatcgcgataagcaacgggcaggcccacacgctgaccctgttggtcgagcagcacaaagtccacgccccaggtatcaatcccaatgctatcgatacgaatcccttcctcgcacaccttgtttaatccaaggcgaatggcactttcaaggctatccacatcccaggtgacatagccgttctgactatgcagcccattgttaaaacgatggatttcgcgcagcgtcaggctgcggcattcacgctcgtaacgcgccagcatcacgcgcccactggatgcgccgagatcgacggcgacacaattgcgaaaggtcataatgtgatcctgctgaatttcattacgaccagtctaaaaagcgcctgaattcgcgaccttctcgttactgacaggaaaatgggccattggcaaccagggaaagatgaacgtgatgatgttcacaatttgctgaattgtggtgatgtgatgctcaccgcatttcctgaaaattcacgctgtatcttgaaaaatcgacgttttttacgtggttttccgtcgaaaatttaaggtaagaacctgacctcgtgattactatttcgccgtgttgacgacatcaggaggccagtatgaccgtattacatagtgtggatttttttccgtctggtaacgcgtccgtggcgatagaaccccggctcccgcaggcggattttcctgaacatcatcatgattttcatgaaattgtgattgtcgaacatggcacgggtattcatgtgtttaatgggcagccctataccatcaccggtggcacggtctgtttcgtacgcgatcatgatcggcatctgtatgaacataccgataatctgtgtctgaccaatgtgctgtatcgctcgccggatcgatttcagtttctcgccgggctgaatcagttgctgccacaagagctggatgggcagtatccgtctcactggcgcgttaaccacagcgtattgcagcaggtgcgacagctggttgcacagatggaacagcaggaaggggaaaatgatttaccctcgaccgccagtcgcgagatcttgtttatgcaattactgctcttgctgcgtaaaagcagtttgcaggagaacctggaaaacagcgcatcacgtctcaacttgcttctggcctggctggaggaccattttgccgatgaggtgaattgggatgccgtggcggatcaattttctctttcactgcgtacgctacatcggcagcttaagcagcaaacgggactgacgcctcagcgatacctgaaccgcctgcgactgatgaaagcccgacatctgctacgccacagcgaggccagcgttactgacatcgcctatcgctgtggattcagcgacagtaaccacttttcgacgctttttcgccgagagtttaactggtcaccgcgtgatattcgccagggacgggatggctttctgcaataacgcgaatcttctcaacgtatttgtacgccatattgcgaataatcaacttcgttctctggccgaggtagccacggtggcgcatcagttaaaacttctcaaagatgatttttttgccagcgaccagcaggcagtcgctgtggctgaccgttatccgcaagatgtctttgctgaacatacacatgatttttgtgagctggtgattgtctggcgcggtaatggcctgcatgtactcaacgatcgcccttatcgcattacccgtggcgatctcttttacattcatgctgacgataaacactcctacgcttccgttaacgatctggttttgcagaatattatttattgcccggagcgtctgaagctgaatcttgactggcagggggcgattccgggatttaacgccagcgcagggcaaccacactggcgcttaggtagcatggggatggcgcaggcgcggcaggttatcggtcagcttgagcatgaaagtagtcagcatgtgccgtttgctaacgaaatggctgagttgctgttcgggcagttggtgatgttgctgaatcgccatcgttacaccagtgattcgttgccgccaacatccagcgaaacgttgctggataagctgattacccggctggcggctagcctgaaaagtccctttgcgctggataaattttgtgatgaggcatcgtgcagtgagcgcgttttgcgtcagcaatttcgccagcagactggaatgaccatcaatcaatatctgcgacaggtcagagtgtgtcatgcgcaatatcttctccagcatagccgcctgttaatcagtgatatttcgaccgaatgtggctttgaagatagtaactatttttcggtggtgtttacccgggaaaccgggatgacgcccagccagtggcgtcatctcaattcgcagaaagattaattcgccatgccgatgccgacgatgttagcggcgacaataatcaccacacaaccgaggctcaacaccgttaccggacggcgtcctgcattgttccactctttcagcaccagcccgacgataccgccgcacaatacatagaaactcatatgcagcatccaactgatgtagtcatactgcgccggaatgcgggcgtggccccaggcatagaaaaagaattgcagataccacatcaacccgcccagtgtcgagagtaacacattgtgaatgatcagcgattttgccagcgagaagtcggcttttagcgacaaatccttcacttttgccagacgaataaaacagaaaccgaggttaatgatcgcgccgccgcccatgatgacaacatagcttggcagagcgacatacagtggatcgacgccaagtgcggcagcggcttcatgcatcggttttgcggcgttcatcgcaaaggacatcccggcagagaaaatgccgcacatcaccgccagcaccagcccttttttcagattgaactcttcggctttaatgcccatcttgcgctctttcaactgcccggcgcgagttacaatccctacgccaatcagcgccaccagaacgccgagcaacgtcatgcgtccgccttcggtgctaatcaacacatcgaaattgccgttgataattggcgtcatcagcgtaccgacaatcaacgtaatgccaatggcgatgccaattcccatcgacatgccgagataacgcatggtcaggccgtagttgatattaccgatcccccacatagcgccgaacagaaaaacaggcagtcgcgtagagagactaaacgagctgtaatacgcccagaaattcggtagtaacagggcgctgatggcccacggcagaataatccacgaaacaatcccaccgactgaccacatggtttcccatgaccatttttttacttttttgaacggagcgtaaaaacaggctgcactggccgcgccgatcaaatgccaaaatatccccatcgtaatcgcgttactcatcttcttatcctcatcatttttcgtcgcgtcacatctccgacgagatgagtgtaaaaatcgtgctgtcgattaacctttcgcctgttgccgccgttgtcgatttactggcaatcacggcattaagtgggtgatttgcttcacatctcgggcattttcctgcaaaaccatacccttacgaaaagtacggcattgataatcattttcaatatcatttaattaactataatgaaccaactgcttacgcggcattaacaatcggccgcccgacaatactggagatgaatatgagctataccctgccatccctgccgtatgcttacgatgccctggaaccgcacttcgataagcagaccatggaaatccaccacaccaaacaccatcagacctacgtaaacaacgccaacgcggcgctggaaagcctgccagaatttgccaacctgccggttgaagagctgatcaccaaactggaccagctgccagcagacaagaaaaccgtactgcgcaacaacgctggcggtcacgctaaccacagcctgttctggaaaggtctgaaaaaaggcaccaccctgcagggtgacctgaaagcggctatcgaacgtgacttcggctccgttgataacttcaaagcagaatttgaaaaagcggcagcttcccgctttggttccggctgggcatggctggtgctgaaaggcgataaactggcggtggtttctactgctaaccaggattctccgctgatgggtgaagctatttctggcgcttccggcttcccgattatgggcctggatgtgtgggaacatgcttactacctgaaattccagaaccgccgtccggactacattaaagagttctggaacgtggtgaactgggacgaagcagcggcacgttttgcggcgaaaaaataatcatttgccgcctgctgcaatgaggcgtataggccgcatatcagcttaaaaaatgaaccatcgccaacggcggtggtttttttgtgatcaatttcaaaataaaaacaatgatccgataaaaataaaacagcgtttcaattgatgtggttttgatcacttttattgattaaatgaatgtctatcttcgtttccatcaacactgatgctccattgaggaattacgcatcagcccttaaaaatatgccgacaggtgatggaaatgcagataaaacgctcgattgagaaaatcccgggggggatgatgctcgtcccgctattccttggcgcactgtgccacaccttctcgccgggggcggggaaatattttggatcattcaccaacgggatgattaccggtacggtgcccattctggcggtgtggtttttttgcatgggggcgtcaataaaattaagcgcgacgggaacggtactgcgtaaatccggtacgctggtggtaactaaaattgccgtcgcgtgggtggttgcggcaattgcctcgcgtattattccggaacatggtgttgaagttggattctttgccggactttcaacgctggcgctggtggcggcgatggatatgaccaatggcggactttacgcttccatcatgcagcagtacggcacaaaagaagaagctggggcatttgtgttgatgtcgttggagtccgggccgctcatgacgatgattattctgggcactgccgggattgcctcgtttgaaccgcatgttttcgtcggcgcagtattaccgttcctggtgggctttgccctggggaaccttgaccctgaattgcgagaatttttcagcaaagcggtgcaaacgctgattccattctttgccttcgcgctgggcaataccattgatttgactgtgattgcccagactggtttgctggggatcctgttgggtgtggcagtaattatcgtgaccggtattccgttgattatcgccgataaattgattggcggtggcgatggcactgccggaattgccgcttccagttccgcaggggccgcggtagcgacacctgtgctgattgcagaaatggtgcctgcgtttaaaccgatggctccggcagcaacttcgctggtagcgacggcggtcattgtgacttcgattctggtgccaattcttacctctatctggtcacgtaaagtcaaagccagagcagcgaaaatcgaaattttaggtacggtgaaataaacctgcttccttaatccccacagccggatgaactaacgttcgtccggtttgctattgagttcctgcctggatacttaccgcgaaaacagcacgcctgacataaaataaatatggtctaatggggaaatttctcgtggagagggaacagatgcgatatccggttgatgtatacacaggcaagattcaggcttatcccgaaggcaaacccagcgcaattgctaaaatccaggttgatggtgagttgatgctgacggagctggggctggaaggtgacgagcaggcggagaaaaaggttcacggcgggccagacagagcgctgtgtcattatcctcgtgagcattatctctactgggcgcgggaatttccggaacaggcggagttgtttgttgcgcctgcgtttggtgaaaacctctcaaccgacggcctgacggaaagtaatgtttatatgggcgatattttccgctggggagaggcattaattcaggtcagccagccgcgctcgccttgctataaactcaattaccattttgatatcagcgatatagcgcagttgatgcaaaacacaggtaaggtggggtggttgtatagcgtgatagcgccagggaaagtgtctgcggacgcgccgctggagttggtttcccgtgtcagcgatgtgaccgtgcaggaggctgccgccatcgcatggcatatgccgtttgatgacgatcaatatcaccgtttactctccgctgccgggttatcgaaaagctggacgcggacgatgcaaaagcgccgactgagcggcaagatcgaagatttttcccgccggttgtggggaaaataacccccggagtgtaggcctgataagacgctatcagcgtcgcatcaggcatcctgctcaaatgccggatgcggcgtaaacgccttatcctgcctgcaaatgcgaagtttaactccgcttatacagcggcaaccaaatcaccagccgtaaaccgcccagcgggctgtcttctgccttcacccagccacgatgctgctgaatggcggtttcaacaatcgccagccccaaacctgtaccgccagattcacgatcgcgtgcttcatcggtacgatagaacggacggaaaatctgttcgcgatcttccgggctaacgccaggaccatcgtcgtccaccgtaatggtgataccgtctttatctaccgcaaagcccacttcaatcttcgtatgggaataacgcagagcattacgaacaatgttttccagcgcactttccagggcgttcggattgccgtacagcggccacggcccaggcgggaagttaactgtcaacgacttgcccatttgctcggcttcgaacgccgcgttatccagcacttcactccacaactggttggctttgatggtttcgctaaccagcgcgtttttttgctgattacgtgacatcaccaacagatcgttgatcatgctgtccagacgttgcgcttcggtttcaatacgctccagttccttgctttcaccgctacgacggcgcagtaacgccgtacccagttgcagacgcgtcagcggggtgcgcagctcgtgagagatatcagaaagcagacgctgctgagaggtcatcatgcgctccagcgcggtgaccatctggttaaaactggcacctgcggcaaggaattcctgtggccccgcttccagttccgggtgctggcgtaagtttccctgggcaacttcatcggcagcgtttttcagcttacgcgccggttttgccagactccaggccaaccacaacagcagcggcgtactgaccaacatggtgacaatcagcagtaatagcgggcggtcaaacagtaagttaatgaaatcggattgagaactgctggccggacgaatcagataaagttggtaattatcttcgccatcacgcacggagaacggaccgaccagttccacgcggccatactttttcttctgcggatgatcggcgttatcggcctgaccaataaagttacgaatgatctgcatttcgctgcgttcagcgccgatcacgcggccttcggtggtcaccaataacaaacgctgtcctggcggtgcccacttatcaatcgcccggaacagacgccgccaccacattaaatcgttgggcggatcgttcgccagctccgcttcgacatgctgctcaatcatcagcccctgacgctgttcgctatccagaagctcggtcatctggcgtgaatcgagcttgggtaacatcaaaaccaacatcaacaccagcgccagcgtcagccagaagatggcgaagatgcgcgcggttaagctgcctatcatgaagcagaaaccatcagatagccgcgaccacgcaaggttttaaaccacgggtgaccatctttacgatccggcagtttacgacgcaggttggaaatgtgcatatcaatagcgcggtcgaaaggcgtcaggcgtttgcccaacacttcctggcttaaatgttcacgggaaaccacctgacccagatgctgtgccagcaaatagagcagggtaaactcagtaccggttaactccagcgtttgcccgtcgaagctggcttcctgacggcctggattcagcactaaggcatcaacttccagtgtcggtgaaccgttgtcgttgttttgctgttgctcgctccagtgcgaacggcgcaggatcgcgcgaatacgtgccaccagctcacgatcattaaacggtttcgggagatagtcatctgcgcccagctcaaggccgagaacgcgatcaagttcactgccgcgcgccgtcaacataatgacaggcgtctggtgtgtctggcgaagtgcttttaatgtgtcgataccatttttcttcggcatcattacgtcaagcaaaagtaaatcaatgctgtcgtccagaagatcaagcgcctgttccccatcgtgggcaacaatcacgttgaagccttccatctcgagcagctcctttaatagggaagtcagctctcggtcatcatcaactaacaggattttattcattgtttaaatacctccgaggcagaaattacgtcatcagacgtcgctaatccatgactttacgttgttttacaccccctgacgcatgtttgcagcctgaatcgtaaactctctatcgttgaatcgcgacagaaagattttgggagcaaatgatgcgcatagttaccgctgccgtcatggcctcaacgctggcagtcagttcattaagccacgctgctgaagtcggttcaggcgataactggcatccgggtgaagaacttacgcagcgcagtacgcagagccatatgttcgacggcataagtttaaccgaacatcagcgtcagcagatgcgagatcttatgcaacaggcccggcacgaacagcctcctgttaatgttagcgaactggagacaatgcatcgccttgtcaccgcagaaaattttgatgaaaacgctgtgcgcgcacaggcagaaaaaatggcgaatgagcaaattgctcgtcaggttgagatggcaaaagtccgcaaccaaatgtatcgcctgttaacgccggagcagcaagcggttttaaacgagaaacatcaacaacgaatggagcagttgcgtgacgtgacgcaatggcaaaaaagttcatcgttgaagctattgagtagtagcaactcacgttcccagtagtaaaccctgttttccttgccatagacaccatccctgtcttcccccacatgctgtgggggttttttttatcctcaatttgcctgctgcttaatgcattgcagatgatttgcttccgttatactagcgtcagttgatagcgggagtatttatgaatcaatcttatggacggctggtcagtcgggcggcgattgctgcgacggcgatggcttcgctgctattgctgattaaaatttttgcatggtggtataccgggtcggtgagtattctcgccgcgctggtggattcgctggtggatatcggcgcgtcgttgacgaatttattggtggtgcgatattccctgcaacctgccgacgataatcactcgtttggtcacggtaaagctgagtccctcgcggcgctggcgcaaagtatgtttatctccggttcggcactattcctgtttttgacgggtattcaacatctgatatctccaacaccgatgacagatccaggcgtcggggttatcgtgacaattgtggcgctaatttgtacgattatccttgtctcgtttcagcgttgggtggtgcggcggacgcaaagccaggcggtgcgggctgatatgctacattaccagtctgatgttatgatgaacggcgcaattctgctggcgctggggttgtcctggtacggctggcatcgcgccgatgctctgtttgcattgggaatcggcatctatattttatatagcgcgttacgcatgggatatgaggcggtacagtcattactggatcgcgcattgcctgatgaggaacggcaagaaattattgatatcgtgacttcctggccgggtgttagcggcgctcacgatcttcgcacgcggcagtcagggccgacccgctttattcagattcatttggaaatggaagactctctgcctttggttcaggcacatatggtggcggatcaggtagagcaggctattttacggcgttttccgggatcggatgtaattatccatcaggacccctgttccgtcgtacccagggagggtaaacggtctatgctttcataatcagtataaaagagagccagacccgcattttgtgtataaaataccgccatttggcctgacctgaatcaattcagcaggaagtgattgttatactatttgcacattcgttggatcacttcgatgtgcaagaagacttccggcaacagatttcattttgcattccaaagttcagaggtagtcatgattaagaaaatcggtgtgttgacaagcggcggtgatgcgccaggcatgaacgccgcaattcgcggggttgttcgttctgcgctgacagaaggtctggaagtaatgggtatttatgacggctatctgggtctgtatgaagaccgtatggtacagctagaccgttacagcgtgtctgacatgatcaaccgtggcggtacgttcctcggttctgcgcgtttcccggaattccgcgacgagaacatccgcgccgtggctatcgaaaacctgaaaaaacgtggtatcgacgcgctggtggttatcggcggtgacggttcctacatgggtgcaatgcgtctgaccgaaatgggcttcccgtgcatcggtctgccgggcactatcgacaacgacatcaaaggcactgactacactatcggtttcttcactgcgctgagcaccgttgtagaagcgatcgaccgtctgcgtgacacctcttcttctcaccagcgtatttccgtggtggaagtgatgggccgttattgtggagatctgacgttggctgcggccattgccggtggctgtgaattcgttgtggttccggaagttgaattcagccgtgaagacctggtaaacgaaatcaaagcgggtatcgcgaaaggtaaaaaacacgcgatcgtggcgattaccgaacatatgtgtgatgttgacgaactggcgcatttcatcgagaaagaaaccggtcgtgaaacccgcgcaactgtgctgggccacatccagcgcggtggttctccggtgccttacgaccgtattctggcttcccgtatgggcgcttacgctatcgatctgctgctggcaggttacggcggtcgttgtgtaggtatccagaacgaacagctggttcaccacgacatcatcgacgctatcgaaaacatgaagcgtccgttcaaaggtgactggctggactgcgcgaaaaaactgtattaatgatttcggaaaaaggcagattcctttaccctgaaaccgatgacagaagcaaaaatgcctgatgcgcttcgcttatcaggcctacatgaattctgcaatttattgaatttgcaaacttttgtaggccggataaggcgttcgcgccgcatccggcatggacaaagcgcactttgtcagcaatatgaggcggatttcttccgcctttttaatccctcaacatatacccgcaagttatagccaatctttttttattctttaatgtttggttaaccttctggcacgctttgctcatcacaacacaacataagagagtcgggcgatgaacaagtggggcgtagggttaacatttttgctggcggcaaccagcgttatggcaaaggatattcagcttcttaacgtttcatatgatccaacgcgcgaattgtacgaacagtacaacaaggcattcagcgcccactggaaacagcaaactggtgataacgtggtgattcgtcagtcacacggtggctcaggtaaacaagcgacgtcggtaatcaacggtattgaagctgatgttgtcacgctggctctggcctatgacgtggacgcaattgcggaacgcgggcggattgataaagagtggatcaaacgtctgccggataactccgcaccgtacacttccaccattgttttcctggtacgtaagggaaatccgaagcagatccatgactggaacgatctgattaaaccgggtgtttcggtgatcacgcctaatccgaaaagctctggtggcgcgcgctggaactacctggcagcctggggctacgcgctgcatcacaacaacaacgatcaggcaaaagcacaggattttgttcgggcactgtataaaaacgtcgaagttctggattctggcgcgcgtggctccactaacacttttgtcgagcgcggaattggcgatgtactgattgcctgggaaaacgaagctctgctggcagcgaatgaactggggaaagataaattcgaaatcgtcacgccgagtgagtctatcctcgcagagccaaccgtgtcggtggtcgataaagtggtcgagaaaaaaggtactaaagaggtggcggaagcctacctgaaatatctctactcgccagaaggtcaggaaattgccgcgaaaaactactaccgtccgcgcgacgctgaggtggcgaaaaagtacgaaaatgcgtttccaaagctgaagttattcaccattgatgaagagttcggcggctggacgaaagcgcaaaaagagcattttgctaacggcggtacgttcgatcagatcagcaaacgctgatttccccaggataattatcaaacccggtggtttctcgcgaccgggttttttatttgtcacgattttgcgttacccttgcatctctttgaggtacagggaaaaaaagatgaaaaaagcgggtcttctttttttggtgatgatagttatcgccgttgtggctgccggtattggttactggaaattaaccggtgaagagtcggatacattacgtaagattgtccttgaggaatgtttgcccaatcagcagcaaaatcaaaatccttcgccatgtgcggaagtcaaacccaatgccggatacgtggttttaaaagatcttaatggcccactgcaatatctgttgatgccaacgtatcgtattaacggtactgaaagtcctttgttgaccgatccttcaacgccgaacttcttttggttggcttggcaggcgcgtgattttatgagcaaaaaatacggccagccggttcccgatcgcgcggtttctttggcgatcaactcccgcaccgggcgtacgcaaaaccattttcatattcatatctcttgtattcgtcctgatgtgcgcaaacagctggataacaatctggcgaacatcagcagccgctggttgccactgccaggtggtttgcgcgggcatgaatacctggcgcgtcgggtaacggaaagcgaactggtacaacgcagcccatttatgatgctggcagaagaagtacctgaggcgcgggaacatatgggacgctacgggctggcgatggtacggcagagtgataactcatttgtattgctggcgacacaacgaaatctactgacgcttaaccgtgcttcagccgaggaaattcaggatcatcagtgtgagattttgcgttaaggcgaagagttaaggaaagtaagtgccggatatgaaatccggcacctgtcagacttaagcctgtttagccgcttctgcagctttaacgattactgcgaaggcgtcagctttcagagaagcaccaccaaccagcgcgccgtcgatatccggctgagcaaacagttctgcagcgttagacgcgtttacagagccgccgtactgaatgatcacttgttcagcgatgttagcgtcaactttagcgatgtggtcacggatgaatttgtgaacagcctgtgcctgagccggagttgcagatttgccagtaccgattgcccatacaggttcgtaagcgataaccgcaccttcgaatgccgcagcaccctgagttttcagtaccgcgtcgatctgacgtgcgcaaacttcttcagttttgcccgcttcattttcagcttcggtttcaccgatgcacagaaccggagtcaggccctgctctttcagcaccgcgaattttttcgcgatcagttcgtcagattctttgtggtaagtacgacgttcagagtgaccgatgatgatgtactgtgcgccgatgtctttcagcatagcagcagaggtttcaccggtgaatgcgccggacaggttcaggtccacgttttgcgcacccagcatgatgtggctgccttcagcttcgcgcttcgccatatcgatatacatttccggtggtgcgattgcaaccgcacagccagcaacacctgccagctctttacgcaggttagaaaccagctcgtgaaccatgtggcggctgccgttcagtttccagttacccatcactaaaggatgtcgcattttaattctccacgcttataagcgaataaaggaagatggccgccccgcagggcagcaggtctgtgaaacagtatagagattcatcggcacaaaggctttgctttttgtcatttattcaaaccttcaagcgattcagatagcgccagcttaatcggttcaacagcgaaggtcagccccttttcgccgttgtccgcgacaacataacgcagtgcaccttctgtctcggtgtaataacgtttgtttttccccgccgttagtagcgactgcagttttttctggctttgtgttttggtcattaatggggtgagtgtgcggatcaccgctgccatgtattcctgagctttcgctttcgcggctttttgctctggcccctggatgggtagccaggtcatttgaatgcttttgatttttaaggtaccgcgctccagcgctgtagaagcatacaagttctcattaattttacttgcagcacgagtgagattggctttgtcgggactgctgtcgatggcacgaaattcgttcagtggcaggctgggattctggctgttaaagtcttctcgaaactggctgatggagagatcgaaagtaggggctccagccagcagataaggcgcggtcgttgccgtatctggtgtttgtgcatgcgcctctgttgtaacggttaatgcagaacataagagaaaaaacagcgtacaccctggcttcattgacagtaccttttgttatgactggctccgattaaaacgatatctgtcgcccttgtcaaaagggtagaatcctggaaaagacaaccatcaaggaacttacatgaccatacagcaatggttattctcatttaaagggcgtattggacgccgtgatttctggatttggataggcctgtggttcgcaggcatgctggtgcttttctcactggcgggtaagaatctactcgatattcagaccgcggcgttttgccttgtgtgcttgctctggccaacagcggcagtaactgttaagcgcttgcatgatcgcgggcgttccggcgcatgggcatttctgatgattgtggcgtggatgctgctggcgggtaactgggcgattttaccgggtgtctggcaatgggcggtggggcgttttgtcccgacgttgattctggtgatgatgcttatcgatcttggtgcgtttgttggcacacaaggcgaaaataaatatggtaaagatactcaggatgtgaagtataaagccgacaataaatcaagtaattaacctttaatatatctcttactgctatttttttccgggattgttatttccacgatgcaaatgacaatacccggaaaatccttctgaactcttcaccttaagcaatatcaaaaaaaatggtaatccataagatcattacttgtttgttcttcccttaacggcgcattattcttaagtcgtaatcgacagagaggcgaatatacagaggtgccctatgaaagatgtcgtagataaatgcagtactaaaggatgtgcgattgatatcggtacggtgattgataacgacaactgtaccagtaagttttcgcgcttttttgccacccgcgaagaagcagagtcttttatgaccaaactgaaagagcttgccgccgctacatcctctgcagatgaaggggccagcgtggcctataagattaaggatctggaggggcaagttgagcttgatgcggccttcactttctcatgccaggccgagatgattatttttgagttatcactgcgttcgttagcttgatggagttgctttagaaggagttaaacatggcttataaacacattggcgtggcaatttccgggaatgaagaagatgccttactggtgaataaagccctggagctcgccagacataatgacgctcacctgacgttaattcatattgatgatggcttaagcgagttgtatccgggtatctacttccctgcaacagaagatattcttcaattgttgaagaataagtcggataacaagctgtataaactgacgaaaaatattcaatggccgaagacaaaactgcgtattgaacgcggagaaatgccggaaacactgctggaaattatgcaaaaagagcagtgcgacctccttgtctgtggtcatcatcactcatttatcaaccgtttgatgccggcatatcgcgggatgatcaataagatgagtgcggatttgctcatcgtgccgtttatcgataagtaaccgcttaccagtaatgctccgctgtcatatggcccggtcggcgacgtaaatgtttcgtcatctgccgggtctctttcagcaactgttgtgtatcgcgcaccatctgtggattgccgcacagcatcacatggctggtttctttattcatcggcaggccaatcgtgctttccagttccccactttcaattaatgccggtatccgtccggtgagcgaccccgctgccgtttcccgactgaccaccgtctgaatgcgcagttttccttcgtagcgtttttccagttcctgcatcagtggcaaatagcttaagtcggcggcataacgtgcggcgtgcaccaggaccagatttttgaagcgatctaaatctttacctagttgcagaatcgataaataagggccaatcgctgtaccggttgccagcatccatagcgtttcgcagtgcggcacttcatcgagcacaaagaatcctgccgcttcgctaaccacctgcacttcatcgcctggtttcagtgccgccagtcgtgggcttaatttgccatcggggacggtgaccaggtaaaactccagatcgggattatcgggcgagtttacataggagtaggcgcgctggacgcgttcgccgtcgatttcaaggccaagcttggtaaattgcccggcggtaaacggaagcacgggggcgtgaacggtgagactaaacagggcgtcggtccagttctgcactttagtgactttgcctgttacccaatcagccatgtttttctcctgttttgattgacttgccttatcttcgttctccgaacaaaaaaattccagtcccgaaggactggaaggctcaatcgatcaaatcaatcagaggatgtgcacctgcatttccgggtctttgcgatccagatagtggatggactgaatgcggcgaatggtgcgtgacttgccgcggatcagcagcgtttcggtagtcgcgatattgcctttgcggctaatgccttccagcagatcgcctttggtaataccggtggcagagaagatgacgttatcgctgcgcgccatatcgcccaggcgcaatactttaccggcttcgatgcccatcgctttgcagcgtgccagctcctgctcgccaatgcgacgattctcttcgttgtcgcctttgacgtcatgacgcgccagcagacgaccgttcatgtcgccatctaatgcgcggatcaccgccgcagaaactacgccttccggcgcgccaccaataccgtacagcacgtcaacttcgctgtctggcatacaggtgagaattgaggccgcaacgtcgccgtccggaatagcaaatacgcgtacgccgagttgctgcatttcagcgataacggcatcgtggcgtggtttagccagaatcgttaccgtcagttcgctcaacggtttgccgagcgccgccgctacattgcgcaggttatccgccagcggcaggttcagatcaatggtgcctttggctcccggcccgacaatcagcttctccatatacatatccggcgcattgaggaagcagcctttatcgcctactgccagcaccgccagcgcgttagcctggcccatcgccgtcatgcgcgtgccttcaatcggatcaacagcaatatctaccgcgtcgccgcgaccagtaccgactttttcaccaatgtagagcatcggtgcttcgtcgatttcaccttcaccaatgacgatggtgccgtcaatgttgacctggttgagcataatacgcatggcgtttaccgccgcgccgtccgcggtgtttttatcgccgcgtcctaaccatttgtagccagccagcgccgctgattcggtgacgcgggaaaattcgatggcaagttctcgtctcatagcaaactctaagcagtaaggaatggcgcgaagtgtagcacaggggaagggagggattattgatgtgtgcggggttgcccccgcacgtttcgggactaccggatgcggcataaacgcttcattcggcatttacattattcgtcgtgttcttcccacgccatcgcgcgtttaaccgcttttttccagcctgcgtaacggtaattacgctcagtggtttcgatgcctggacggaactcgcgctcaatcaccgctttctcttgcagctcgtcgaggttctgccagaagccaaccgccaggcctgcgagataggccgcacccaatgcggtgacttcgcgcacttccgggcgctcaacgcgggtgccgagaatatcggactggaactgcatcaggaaattgtttgctactgcgccaccatccacgcgcagggcgtgcagacggataccagagtcggcctgcatcgcttccagcacgtcacgcgtctgataagcaatagactccagcgtcgcgcgtataatgtggttagcgttcaccccacgagtcagaccgaaaatcgccccgcgcgcatacgggtcccagtacggcgcacccagcccggtaaatgccggaaccacatacacaccattggtgttttgcactttggtggcgaaatattcggaatcgtaggcgtcgttaatcaacttcatttcatcgcgcagccactgaatggatgcgcctgccataaacaccgcaccttccaacgcatagttcacttcgccagtcgggccgcaggcgatggtggtcagcaggccgttttctgatttcaccgctttctcgccagtgttcatcagcataaagcagccagtgccataggtgttcttcgccatcccttctttcacgcacaactgaccaaacagcgcggcctgctggtcaccggcgatcccggagattggaatacgcgtgccgcctttgccgccaatgttagtctgaccgtatacttcggaagaacgacgcacttctggcagcatctcgcgcggaatatccagcacttccagcattttgtcgtcccagtccagggtatggatgttgaacaacatggtacgagaggcgttggtgtaatcggtcacatggacacggccctgagtcattttccagataagccacgtatcaaccgtaccaaacagcaattcaccacgacgtgcacgctcgcgagagccttccacatggtcgaggatccacttcactttggtgccagaaaagtacgggtcaatcaccagaccggtattgctgcggatataatcttctaaaccgtcacgttttaaatgctcgcagatttctgcggtacgacggcactgccagacaatggcgttatagataggcttgccggtttctttttcccagacaatagtggtttcacgctggttcgtaataccgatagctgcaatttgatcggaactgatatcggctttcgccagcacttctaccagcgtggagctttgggtggcccagatttccattgggtcgtgttctacccaacctggttttgggtagatttgctcaaattcgcgctgcgacacgctaatgatattggcatcgtgatccattacgaccgcgcgggagctggtggtgccctggtcgagcgcaacgatatattttttttcagtcatgtttaattgtcccgtagtcatattacagcgaagctttttgttctgaaggagttgtggtttccttttcttccacaacacagatatcgcaaggcaaatggcgaccaatcagtttgcggtaggcaaatgcacctacaatcgcgccaacgatagggccgaaaagcggcaccaggaagtaaggaatgtctctgccgccggtaaaggcgacattgccccagcccgccagccaggcaaagactttcggaccgaagtcacgcgctgggttcatggcaaaacctgtcaatgggcccatagatgcgccaatgaccgcaatcagtagaccaatcagcaagggagccaaagggccgcgtggtacaccgttgccatcgtccgttaacgccaggatcagccccatcagaatagcggtaatcaccatctcaactgcgaaagcctgcacaaaattgatatgaggattagggtaagtagagaaagtgccagccagatcaacactttcaacgctgccgcgaacaatgtgatgagtctgctcgaagtcgaaaaataaattgtagtaaagcccgtaaactaaagccgcagcacagaaagcgccggcaacttgtgaaacgataaaaggaataactttgcgcttgtcgaaacaggcaaacagccacaatgcaatggtaacagcgggattaagatgcgcgccggaaacccctgcggtcaggtagatggccattgccacccccagtccccaaatgacactgatttcccactgaccaaaagacgcaccagcgacttttagtgctgcaacgcaacccacaccgaagaaaatcaacaacccggtaccgaggaattcagcaatgcactggcctttcaaggttgatgtttgactcataatcggatcctgaagagttaatgtttgttgtatgcgtgaaagtcacggacctccacgatgcttgtaggcatgctgtaaacttatcgttaacgagcaaaaacgagaaatatcgaacttaaaatgtgtgtgcctcgtcataaaatgagcgttatcgcgccatttattccatctgattgtacatgatgcatgtttgttagatcattcgcgcaacaaatttattaacattttcgattgatgtggattatgtcaccaggagaaggatgaaaagtgtggcaaaccgtaatctgcaaggcgtgccgctggacagcgatggcgcggcttcatacaatcggagctaactaaagtgcgctcgtatttattaaggcgtcaccggtaatcgggacgaggatttttatccatcaacgccttgcaattcaggagaggtatgacaatgtcattagaagtgtttgagaaactggaagcaaaagtacagcaggcgattgataccatcactctgttgcagatggaaatcgaagagctgaaagaaaaaaacaactcactgtcgcaggaagttcaaaatgcccagcatcagcgcgaagagctggagcgtgagaacaaccatctgaaagaacagcagaacggctggcaggaacgtctgcaggccctgctgggtcgcatggaagaggtctgattacgcttcatcttccgcgtaatttctttactgtgtaggccaacaggtaacgcagaaaaaaggcaccttgcggtgcctttcttatcattcaatatccagcggatcttctgaaagaataatcccggtattgtcggcataaagatggtcgccggagaagaaggtgacaccgccaaaattgacgcggacatcgctttcgccaatgccttcgccagcggcaccaaccggaattgccgccatcgcctggatgccgatatccaactcttccaggtcatctacctgacgcaccgcgccgtaaatgaccagaccttcccattcattttgtactgccagacgcgccagttcagcatcgaccagtgcgcgacgaacagaaccaccgccatcgacgacaagaacacgaccacggccattctgttcgagcagatcgtacagcaacccgttgtcctcgaaacattttaccgtgattatttgtccgccaaacgacgcccgtccgccaaagttggagaacagcggttccacgacgttaacatcttcttgatagatgtcacaaagctcggaagtatcgtatttcataggcttaacattcagttgctgcgagaattttcagtatatcgcgctatgtgggctgttggcaaaatcatcaattgttaattgatatttgtcagttatgctgcccactggcttaggaatatccctaaaacaaacagcaggttagtcagtaacgctcccttgacagtacgttccagcattggtcgcatcgccaccgggtccatttcccgcatcacataacgggcttgcttcaccagtaatggtgccgccagcaggaacagccagccccacaggctatgcagcgaaaagagattaaacagcgccagacacaccagcgagcccatcagcaggcaggcatgataacgacgcgcgttcacttcacctaagcgcaccaccagcgtgtttttgccattttcgcggtcgctattgatatcacgcaggttattaatattcagtactgccgttgccagcaggccgcatgcggtcgccggaaggatcagtgccggaatcaatgtatgagcctgtaaataccagctccccatgacactcaaccagccaaagaaaaccagtacggaaatatcacccagaccgatataaccataaggacgattgcccacggtgtaggtgatagcggcaatgatcgacaacccgccaagaatcaggaaaccgacaaaatcggccagcgtatggcatgccactgcaaccagtgccagcccggagagacagatgagcacgacggtaataatgagcgcccgtttcatctcttgctgggtaatgacccctttttgcatgccgcgtagcggcccaatgcggtcaggtttatcgctgccttttaccgcatcgccgtaatcattggcgaggttagaaaggatctgtaatagcccggcggtaattagtgccagcagggcgaccagcggatcgaagtgaccttgccaccatgccagcgctgtcccgacgataattgcagcaaaggcgagggggagggttttaggtcgtaaactttccagccacgcctgagttcggctaatttgttgttcagtcataatacgcgccaataaaaatggggcctttcagccccatcaaacaatgatgaaaatgattgaacgcgattataggataaaacggctcagatcttcatctgccaccaacgcatccagatgtttgctcacataatctgcgtcaatagtgatattttgaccgcttaaatcgctggcgtcgtaggaaatctcttccattaaacgctccagaacagtgtgtaaacgacgagcaccgatgttttcggtagattcgttcacctgccatgccgcttccgcgatgcgtttaataccggagtcggtaaactcgatatttacgccttcagtcgccatcagtgctttgtactgcacggtgatagaggcattcggctcggtcagaatacgctcgaagtcgctggtggtcagcgcctgcagttcaacgcggattggcagacgaccttgcagttccgggatcaggtcagacggtttcgcaatctggaacgcgccagaagcgataaacagaatgtggtcagttttgaccatcccgtgtttggtggaaacggtgcaaccttctaccagcggcagcaggtcacgctgaacgccttcacgagaaacatccggaccggaagactcgccgcgcttacagattttgtcgatttcgtcgataaacacgatcccgtgctgctcaacagcgtcgatagcgtcttgcttcagctcttccgggttcaccagtttcgccgcttcttcttcaatcagcagcttcatggcgtctttgattttcagcttacgcgctttttgcttctggccgcccaggttctggaacatggactgcagctggctggtcatctcttccatgcccggaggagccataatttcaacgcccatcggtgctgcggcaagatcgatctcgatttctttgtcatcaagctggccttcacgcagttttttgcggaatgcctgacgagcagcggacggttcctgctgctgttcggtctgtccccagttgtttttagcaggtgggatcagcacgtcgagaatacgttcttctgccagttcttcagcgcgataacggtttttctcgatagcctggacgcgtaccattttcacggcggcatcggtcagatcgcgaataatagaatccacttccttaccgacgtagcccacttcggtgaatttggtcgcttcaactttgatgaacggcgcattcgccagcttagccagacgacgggcgatttcagttttaccgacaccggtcgggccgatcatcaggatatttttcggggtcacttcatggcgcagctcttcgttgagctgcatgcgacgccagcggttacgcagagcaatcgccacagaacgcttggcgttgtcctggccgatgatgtgcttatccagttcgctgacgatttcgcgtggggtcatttcagacatgggagatccttacgctttgtagcttaattcttcgatggtgtggaaatggttggtatagatgcaaatgtcgcctgcaatatccaacgccttttcagcaatttcacgggcgctaagttcagtgttttctaacagcgcgcgcgccgcagcctgggcgtaagggccgccggagccgatagcaataagatcgttttctggctgcaccacgtcaccgttaccggtgatgataagcgatgcagtttcatccgcgactgccagcagtgcttcaagtttgcgcagcatgcgatcggtacgccagtcttttgccagctcaacggcggctttgaccagatggccctgatgcatttccagtttacgttcaaacagttcgaacagcgtaaaagcatccgcagtaccgcccgcaaagcccgcgatgactttgtcgttgtacagacggcggacctttttcacgttgcctttcattacggtattgcccaacgtggcctgaccatcaccagcgatgaccacatggccgttacggcgtacgcttactatagttgtcacgagctgaccccttggttacgaatacagagtacaaaccccgtacaaaagtacggggcataatgcaattatagatgggggggattttgagggtttcaacccccggcggcgagccgaatgcagtttgtatgacccgccatcttcaaccgattgagggtgctgtctgcgttctctttgcctttcaccgggccaatgaccacacgattccagccattgttggtggtgattttcgagtcaaagccttcgaacgccagctgagcacgtaccgtctctgcctgttccgcgcctctgaacgaaccgcactgcaccatccagcggcgttcgtcttttttctccgccgtcggttttggcgcgtcagcggcacgagcaactggcgcagcttgctgcggcttcgactgcgcagtcgtgtgcgcaggagtttgcagcagatcctggtacggctgctgagaagaagccggtttagactggcgcggttgcgcctgtaccggtgcggcttgcgacgtacgcgtctgctgctgccagctttgttcagtcgtacgcgactgctgagccaggcgttgctgttccgctaattgctgcgcctgacgttggcgctgtagcgtttgctgacgctgttccggcgtctgttcattccacggaacttcaaccagctgcgttggctgctggcgcatatcagcctgcatttgttcaagaagctgacgttgttctggtgtcagttgctccggcgttttcacttcaccaccggcagaaggttctgtgggcgcacgcactcccggctggcgactttccagctctttaatgtagcgccagcgttcttctggttttggtggtagtccgtttccggtcactttctggctttgcagcgtctcggactcttctttcttgtgatgcgtaatgaagtacagaccaccgataaaggtcacaagaacggcggcagcaatagcgaccatagcgggagaaaccgcaggcagatttcgttgctttttccgtgaggtgctcttttttcgccgcgaaggtgccggttggctgcggcgtacataatctcgttgtgccactatcgtttcgctgtatttattcgttcgtcagcccgccatgttacttaagcggcgggcctttgaccagtcacggcagtcttaaaggtttactttaaggtaacgcgcgtgttgatccccggatgataagttcgcagtccattaaacgagagccactgccaacgtgttgcccctgcatttgatcaagcaataacagcatagcttcccgaccgatttcgtaacgcggctgcgcgatggttgtcagcggcggatcacaaaattgcgtcaggtcgatgttatcaaaaccgattatggaaaggtcttccgggactttcagcccctggcgttttgcctgagaaagtgcgccgagcgccatcacatcgctatggcagaagacagcagtaggcggttgtggaagatcaagcagctgctgcatcgctttgcttccggcttcgaaggtgaagtcgccacgggcgatgtattgcggatcaaccataatgccgcagcgacgcagcgcctgaacatagccttgcaggcggtagtgacacagcggcatctcttcgggaccggctatacagccaatccgtttatgcccttgctcatataaataatttactgcatcaaatgcggcggtcagattgtcgatatgaactgtaggcagctccagctccggtgcaaattcgttcgccatcaccatcggcggcagattacgctgttcctcaatgctggcatcaaacggcagccttgaacccagcaacaacatgccatcaatttgcttggtgatgatcaaatcgataaaggttttttcctgctgattttgatgcgcacagtcgccaatcagcaccagatatccgtgatttgccgccgtaacttcgataccgcgaataatttcgctaaagaagggatcgcagatatccgggacaatcaccagaatggtgcgggattcattacgcttgacgttgcgccccataggctgcggtaaataacccacttcccgggccgctttttcaacccgattacgggtggcctgggagactttatcgggattcattaatgctcgggagacggtcgctgtagagacttttgccttgagggcaacgtctttcatggtcgcggcagtttcctgcttcttcgctttcacactcactcctcgcctggcacgtcaggcgtactacatccatgtttacttcacatcggcaacatttttagcagatagcgcgtgaaaacggttacagaattttcatgaaaagtgtgatgaatattgaatttttcgatccgcctcgcatcgtgagcggtttaaccctcaatcggatcaacatccagcacccatttcaccttacgggaatccggtattgtattgatgagcgccagcgtaccgttaatgatgtgttgcaagcgcacgcgggaagggtgctgcaacaatatctgccagcgccagcgaccgccacgtttaggtgccagagccggaaccggaccgagaacccacagtttctcgtctgccagtgggctggagaggatcagattacgcagttgttgcaggaacaatggcgcgtgctgattgttatgatcttccgcacgcacaatcacatggctggtccacggcggtagctgcatcattcgccgctcagccagcgcctgttcggcaaaggcgtcgtagcctttatagagcaacgtttgcaacagaggatgttccggatggtgcgtttgcagcaccacttcgccctgtttacccgcacgcccggcacgaccggcgacctgggtgtaaagctgagcgaaacgctctgccgagcgaaaatcggcagaaaacagcgcgccgtccacgtccagtaatgcaaccagcgtcacatccgggaaatggtgacctttcgccagcatttgtgtaccaatcaaaatccgcgcgccgccgcgatgtacttctgccagttgctgttccagcgcccctttgcggctggtggtatcgcggtcgatacgagaaatgggcacgccggggaacaacggcgcgagcgtctgttcaagctgttcggtgcccagccccacggggaccaggtgcgtggaaccgcaggaagggcactggcgcggcaccggacgctgactgtcacagtggtggcagcgcagatggtgctgcgcctgatgcagcgtgtagtagtgatcgcaacgtgggcattcggcaatccagccacagtcgtggcacagcagtgcaggcgcaaagccacggcggttaagaaagagaatgacctggttatcagcctgtaaatgctggcgcatacgagtgattaacgccggagccagacctgcctgcaccttctgaccttttaaatccagcacatgttgaattgccggacgcgcattccctgcccgacgggtcaggcgcagcaggcggtattttttctgctggacgttgcataacgtttccagcgcgggcgttgcggagccaagaataatcgggatttgctcgctgtgcgcacgatacaccgccaggtcgcgggcatgatagcgccagccttcctgctgcttgtaggagctgtcgtgctcttcatcaatgacaatcacgccgagatttttaaacggcgtaaacagcgcggagcgggtgccgatcacaatcgccgcctcaccatttttcgctttcagccacgccgaaagacgctcgctgtcgttcaggccggaatgcagaacttccacgggggcattaaaacgttcacgaaaacgggcgatagtttgcggtgtcaggccgatttccggcaccatcaccagcgcctgtttgccctgagcgagcacgttttccagtacgctgagataaacctccgttttaccggaaccggtaacgcccgccagcagccaggcagaaaaagtatctgccgcgctatgaattgcgccaacggcggtggcctgttcggtattcaatcgcaaccgctcaccagaaacggcatagttcgttcgccagtcgctaaactctggtgtttcacttgctaaatcacacagaccttttttgcgtagcgcctgcaacgcggcatcattaaattcgagcgtggcgacctggtcgcgccagattttgccttgccgtaacgccgccagcgcctgttgttgcttgggggagcgtttcaggctgttcagatccaccgcctggccttgttcagtggcaaaccagtaccacatcggcgcgttcgccgcaggccgcccctggcgtagtaaaatcggcaaggcatgaaacagcacatcgccaatcggatgatgatagtaatctgccgcccatagcagcaatcgccagacggagtgagtaaacaccggctcactatccagcacttcgactaccgcttttagctcattgagcggcagttcgctggcatcgctaactgataccacaatcccgatgcgctcctgctgtttgccaaacggcacgcgcacgcgacacccagctttaaccgtcatgccttctggcagcagatagtcaaaggtacgaggaagcggaacgggcaaggcaacgtgggcaacgggcatagcatcatcctgacttgaaattcggtgggttagtatacacattgccgtagaagagtgcggatcagtttgcatacgctggttaatttctgtatgatttcgcgccttcgtacgaaatgatcgtattgaagctatacttttaacatcgcgtggtgtctggcgttagggctggaagagcgacgcggccttaaaccgaggttttcccatgaaaaaagatattcacccgaaatacgaagaaattactgctagctgctcttgcggtaacgtaatgaaaatccgctccaccgttggtcatgacctgaacctcgacgtgtgcagcaagtgccacccgttcttcactggcaaacagcgtgatgttgctaccggtggccgtgttgaccgcttcaacaagcgtttcaacatcccgggcagcaaataagaccggatttccgaaaaaagcgccgcacggcgctttttttgtgcctgaattttggtcgtattaccacgaaaacagcggccattctttggcgaccgtggtgagttgtggcgcatcgaaaacggcttgtggcgagaccaccgtttcctcaagcggaatattcttgccgtaacgttctttgagctttgcctgaacttgtgggctgctcaggtcgaactctttcaacttctgctgctcgcccacgcgcattcccagcgcgttctggtaaaccttccacaccacttccgaacagtactggcgatcgtcgctccatgagaagctgaaatcatacggtttaccgagataacgttttgccgtttgcgccagtttttgctgttgttcaacactcagtccgccttcaacgcggcgaacaacgtatttgcccttttcaccatgggcgatccactgcttgagcggggtgtatttcaccgggccgactgcttcaaaaacgtagggctttttgttgcgtatcaccagcataccggtgtggctataatcggtatgggtcgccagttggatcgctttactttgcgatgagcgagagatctgaaagatgatgtcgccggtttgtggctgccaggcaaaggcaggtacagaaaccagcaggctgaggatcagcagcctgtttttcatagttaaacgtccatgtataaaaagcggtgggtcgcagacaacgtgctcgttgtttatgccggatgcggcgtgaacgccttatccggcctacaagttcgtgcaaattcaataaattgcaatatgacgtaggcctgataagcgtagcgcatcaggcgattccactccgcgccgctcttttttgctttagtattcccacgtctccgggttaatccccatctcacgcatgatctcttttgccgcttccgggatttcgtcgctgcgctctttacgcagatcggcatcatccggcaaaggttgcccggtaaaggcatgcagaaacgcttcgcacagcagctcgctgttggtagcgtgacgcaggttgttcacctgacgacgcgtgcgttcatcggtgaggatttttaacaccttaagaggaatggaaaccgtaatctttttgacttgttcactcttcttgccgtgctcagcgtatgggctgatatattcgccgctccattcagccatgagatacttaatcctcttcgtcaataaattgagaccagaccacacagttgatgtgggtactgaccgtaaacccgcatagtttaccgtacaggcgttaccgtgacatcgtgtaatgcacctgtcggcgtgataatgcatataattttaacggctatttgggatttgctcaatctatacgcaaagaagtttagatgtccagatgtattgacgtccattaacacaatgtttactctggtgcctgacatttcaccgacaaagcccagggaacttcatcacatgacgcgtaaacaggccaccatcgcagtgcgtagcgggttaaatgacgacgaacagtatggttgcgttgtcccaccgatccatctttccagcacctataactttaccggatttaatgaaccgcgcgcgcatgattactcgcgtcgcggcaacccaacgcgcgatgtggttcagcgtgcgctggcagaactggaaggtggtgctggtgcagtacttactaataccggcatgtccgcgattcacctggtaacgaccgtctttttgaaacctggcgatctgctggttgcgccgcacgactgctacggcggtagctatcgcctgttcgacagtctggcgaaacgcggttgctatcgcgtgttgtttgttgatcaaggcgatgaacaggcattacgggcagcgctggcagaaaaacccaaactggtactggtagaaagcccaagtaatccattgttacgcgtcgtggatattgcgaaaatctgccatctggcaagggaagtcggggcggtgagcgtggtggataacaccttcttaagcccggcattacaaaatccgctggcattaggtgccgatctggtgttgcattcatgcacgaaatatctgaacggtcactcagacgtagtggccggcgtggtgattgctaaagacccggacgttgtcactgaactggcctggtgggcaaacaatattggcgtgacgggcggcgcgtttgacagctatctgctgctacgtgggttgcgaacgctggtgccgcgtatggagctggcgcagcgcaacgcgcaggcgattgtgaaatacctgcaaacccagccgttggtgaaaaaactgtatcacccgtcgttgccggaaaatcaggggcatgaaattgccgcgcgccagcaaaaaggctttggcgcaatgttgagttttgaactggatggcgatgagcagacgctgcgtcgtttcctgggcgggctgtcgttgtttacgctggcggaatcattagggggagtggaaagtttaatctctcacgccgcaaccatgacacatgcaggcatggcaccagaagcgcgtgctgccgccgggatctccgagacgctgctgcgtatctccaccggtattgaagatggcgaagatttaattgccgacctggaaaatggcttccgggctgcaaacaaggggtaaaaatgagtgtgattgcgcaggcaggggcgaaaggtcgtcagctgcataaatttggtggcagtagtctggctgatgtgaagtgttatttgcgtgtcgcgggcattatggcggagtactctcagcctgacgatatgatggtggtttccgccgccggtagcaccactaaccagttgattaactggttgaaactaagccagaccgatcgtctctctgcgcatcaggttcaacaaacgctgcgtcgctatcagtgcgatctgattagcggtctgctacccgctgaagaagccgatagcctcattagcgcttttgtcagcgaccttgagcgcctggcggcgctgctcgacagcggtattaacgacgcagtgtatgcggaagtggtgggccacggggaagtatggtcggcacgtctgatgtctgcggtacttaatcaacaagggctgccagcggcctggcttgatgcccgcgagtttttacgcgctgaacgcgccgcacaaccgcaggttgatgaagggctttcttacccgttgctgcaacagctgctggtgcaacatccgggcaaacgtctggtggtgaccggatttatcagccgcaacaacgccggtgaaacggtgctgctggggcgtaacggttccgactattccgcgacacaaatcggtgcgctggcgggtgtttctcgcgtaaccatctggagcgacgtcgccggggtatacagtgccgacccgcgtaaagtgaaagatgcctgcctgctgccgttgctgcgtctggatgaggccagcgaactggcgcgcctggcggctcccgttcttcacgcccgtactttacagccggtttctggcagcgaaatcgacctgcaactgcgctgtagctacacgccggatcaaggttccacgcgcattgaacgcgtgctggcctccggtactggtgcgcgtattgtcaccagccacgatgatgtctgtttgattgagtttcaggtgcccgccagtcaggatttcaaactggcgcataaagagatcgaccaaatcctgaaacgcgcgcaggtacgcccgctggcggttggcgtacataacgatcgccagttgctgcaattttgctacacctcagaagtggccgacagtgcgctgaaaatcctcgacgaagcgggattacctggcgaactgcgcctgcgtcaggggctggcgctggtggcgatggtcggtgcaggcgtcacccgtaacccgctgcattgccaccgcttctggcagcaactgaaaggccagccggtcgaatttacctggcagtccgatgacggcatcagcctggtggcagtactgcgcaccggcccgaccgaaagcctgattcaggggctgcatcagtccgtcttccgcgcagaaaaacgcatcggcctggtattgttcggtaagggcaatatcggttcccgttggctggaactgttcgcccgtgagcagagcacgctttcggcacgtaccggctttgagtttgtgctggcaggtgtggtggacagccgccgcagcctgttgagctatgacgggctggacgccagccgcgcgttagccttcttcaacgatgaagcggttgagcaggatgaagagtcgttgttcctgtggatgcgcgcccatccgtatgatgatttagtggtgctggacgttaccgccagccagcagcttgctgatcagtatcttgatttcgccagccacggtttccacgttatcagcgccaacaaactggcgggagccagcgacagcaataaatatcgccagatccacgacgccttcgaaaaaaccgggcgtcactggctgtacaatgccaccgtcggtgcgggcttgccgatcaaccacaccgtgcgcgatctgatcgacagcggcgatactattttgtcgatcagcgggatcttctccggcacgctctcctggctgttcctgcaattcgacggtagcgtgccgtttaccgagctggtggatcaggcgtggcagcagggcttaaccgaacctgacccgcgtgacgatctctctggcaaagacgtgatgcgcaagctggtgattctggcgcgtgaagcaggttacaacatcgaaccggatcaggtacgtgtggaatcgctggtgcctgctcattgcgaaggcggcagcatcgaccatttctttgaaaatggcgatgaactgaacgagcagatggtgcaacggctggaagcggcccgcgaaatggggctggtgctgcgctacgtggcgcgtttcgatgccaacggtaaagcgcgtgtaggcgtggaagcggtgcgtgaagatcatccgttggcatcactgctgccgtgcgataacgtctttgccatcgaaagccgctggtatcgcgataaccctctggtgatccgcggacctggcgctgggcgcgacgtcaccgccggggcgattcagtcggatatcaaccggctggcacagttgttgtaatttcagaaatttaataatgcccggtactcatgttttcgggtttatggtttctaatgaaatatattgaattatcataggattaggccggattaagcgtttacgacgaatccggcaagaagcaataagtacatggttagtttatatttgcagtccggtttgctttgcataccggattttctttttcttaccatcctgaagttttttcatcttccctgatttttcctcaccatcattggtcatttttcggttgacgcccttcggcttttccttcatctttacatctggacgtctaaacggatagatgtgcacaacacaacatataactacaagcgattgatgaggtaaggtatgagcttttttcacgccagccagcgggatgccctgaatcagagcctggcagaagtccaggggcagattaacgtttcgttcgagtttttcccgccgcgtaccagtgaaatggagcagaccctgtggaactccatcgatcgccttagcagcctgaaaccgaagtttgtatcggtgacctatggcgcgaactccggcgagcgcgaccgtacgcacagcattattaaaggcattaaagatcgcactggtctggaagcggcaccgcatcttacttgcattgatgcgacgcccgacgagctgcgcaccattgcacgcgactactggaataacggtattcgtcatatcgtggcgctgcgtggcgatctgccgccgggaagtggtaagccagaaatgtatgcttctgacctggtgacgctgttaaaagaagtggcagatttcgatatctccgtggcggcgtatccggaagttcacccggaagcaaaaagcgctcaggcggatttgcttaatctgaaacgcaaagtggatgccggagccaaccgcgcgattactcagttcttcttcgatgtcgaaagctacctgcgttttcgtgaccgctgtgtatcggcgggcattgatgtggaaattattccgggaattttgccggtatctaactttaaacaggcgaagaaatttgccgatatgaccaacgtgcgtattccggcgtggatggcgcaaatgttcgacggtctggatgatgatgccgaaacccgcaaactggttggcgcgaatattgccatggatatggtgaagattttaagccgtgaaggagtgaaagatttccacttctatacgcttaaccgtgctgaaatgagttacgcgatttgccatacgctgggggttcgacctggtttataaatagtgtggcttttgtgaaaatcacacagtgatcacaaattttaaacagagcacaaaatgctgcctcgaaatgagggcgggaaaataaggttatcagccttgttttctccctcattacttgaaggatatgaagctaaaacccttttttataaagcatttgtccgaattcggacataatcaaaaaagcttaattaagatcaatttgatctacatctctttaaccaacaatatgtaagatctcaactatcgcatccgtggattaattcaattataacttctctctaacgctgtgtatcgtaacggtaacactgtagaggggagcacattgatgagcacgtcagacgatatccataacaccacagccactggcaaatgcccgttccatcagggcggtcacgaccagagtgcgggggcgggcacaaccactcgcgactggtggccaaatcaacttcgtgttgacctgttaaaccaacattctaatcgttctaacccactgggtgaggactttgactaccgcaaagaattcagcaaattagattactacggcctgaaaaaagatctgaaagccctgttgacagaatctcaaccgtggtggccagccgactggggcagttacgccggtctgtttattcgtatggcctggcacggcgcggggacttaccgttcaatcgatggacgcggtggcgcgggtcgtggtcagcaacgttttgcaccgctgaactcctggccggataacgtaagcctcgataaagcgcgtcgcctgttgtggccaatcaaacagaaatatggtcagaaaatctcctgggccgacctgtttatcctcgcgggtaacgtggcgctagaaaactccggcttccgtaccttcggttttggtgccggtcgtgaagacgtctgggaaccggatctggatgttaactggggtgatgaaaaagcctggctgactcaccgtcatccggaagcgctggcgaaagcaccgctgggtgcaaccgagatgggtctgatttacgttaacccggaaggcccggatcacagcggcgaaccgctttctgcggcagcagctatccgcgcgaccttcggcaacatgggcatgaacgacgaagaaaccgtggcgctgattgcgggtggtcatacgctgggtaaaacccacggtgccggtccgacatcaaatgtaggtcctgatccagaagctgcaccgattgaagaacaaggtttaggttgggcgagcacttacggcagcggcgttggcgcagatgccattacctctggtctggaagtagtctggacccagacgccgacccagtggagcaactatttcttcgagaacctgttcaagtatgagtgggtacagacccgcagcccggctggcgcaatccagttcgaagcggtagacgcaccggaaattatcccggatccgtttgatccgtcgaagaaacgtaaaccgacaatgctggtgaccgacctgacgctgcgttttgatcctgagttcgagaagatctctcgtcgtttcctcaacgatccgcaggcgttcaacgaagcctttgcccgtgcctggttcaaactgacgcacagggatatggggccgaaatctcgctacatcgggccggaagtgccgaaagaagatctgatctggcaagatccgctgccgcagccgatctacaacccgaccgagcaggacattatcgatctgaaattcgcgattgcggattctggtctgtctgttagtgagctggtatcggtggcctgggcatctgcttctaccttccgtggtggcgacaaacgcggtggtgccaacggtgcgcgtctggcattaatgccgcagcgcgactgggatgtgaacgccgcagccgttcgtgctctgcctgttctggagaaaatccagaaagagtctggtaaagcctcgctggcggatatcatagtgctggctggtgtggttggtgttgagaaagccgcaagcgccgcaggtttgagcattcatgtaccgtttgcgccgggtcgcgttgatgcgcgtcaggatcagactgacattgagatgtttgagctgctggagccaattgctgacggtttccgtaactatcgcgctcgtctggacgtttccaccaccgagtcactgctgatcgacaaagcacagcaactgacgctgaccgcgccggaaatgactgcgctggtgggcggcatgcgtgtactgggtgccaacttcgatggcagcaaaaacggcgtcttcactgaccgcgttggcgtattgagcaatgacttcttcgtgaacttgctggatatgcgttacgagtggaaagcgaccgacgaatcgaaagagctgttcgaaggccgtgaccgtgaaaccggcgaagtgaaatttacggccagccgtgcggatctggtgtttggttctaactccgtcctgcgtgcggtggcggaagtttacgccagtagcgatgcccacgagaagtttgttaaagacttcgtggcggcatgggtgaaagtgatgaacctcgaccgtttcgacctgctgtaatctgaccccgttcagcggctgcttgctggcagtcgctgaacgttctttaccagcgtatagtgggcgaacgaaaactacacactggatctctcatgtctgccgcaggaaagagcaacccactggcaatcagtggcctggttgtgctcacacttatctggagttatagctggattttcatgaagcaagtcaccagttacatcggtgccttcgactttaccgccttacgctgcattttcggcgctctcgttttattcatcgtccttttattacgtggtcgcggaatgcgcccgacaccgtttaaatacaccttagccattgccctgttacaaacctgcgggatggttggtctggcgcagtgggcgttggtcagcggaggtgcggggaaggtggcgatcctgagctataccatgccgttctgggtggtgattttcgccgcgttgtttctcggtgaacgcctgcgacgtgggcaatatttcgcgattctgattgccgctttcggcttatttttggtgttgcagccgtggcaactcgatttctcttcgatgaaaagtgccatgctggcaatcctctccggcgtcagttggggggcgagcgcgattgttgctaaacgtctgtatgcccgtcatccgcgcgtggatttattgtcgttaacatcctggcagatgctgtatgcggcgctggtgatgagtgtggtcgctttactggtgccgcaacgtgaaattgactggcagcccaccgtgttctgggcgctggcctacagtgcgattctggcgacggcactggcgtggagcttatggttgtttgtattgaaaaacttgcctgccagtattgccagcttaagcacactggccgttcccgtttgcggcgtactcttttcctggtggctgctcggcgagaatccgggggccgttgaaggtagcggtattgtgctgattgtgctggcactggcgctggtgagccgtaagaaaaaagaagccgtcagtgtaaaaaggatctgaattttttcttcatgtggggcgatctcttatttaacaaaataacgataatgccccaccatccgccagttaaacagcacatcttcttcctgcgcgcctgcgccaatgttatgtatcaccagcggcgtaccgtcgcgggcgaagccatctgaaaccaccccaatatgtgccagcccgttatccagtcgccaggagacaatatcgcccgcttgatagtcactggggttcttgctggtggggcgtgttttatcatggcggctaaaccaggtttccagattaggcacccgacggtgatcgatgttgctgtccgggcgctttaacttccatttttgcgggtactcagcaaaattcttcgccatatcttcgtgaaccagtttctgcaaatcgaccttctggctgcgcaatgcgcggatcaccacatcggaacatacaccgcgttcttgcggaacatcaccgccaggataagtaagctgcacatacgccggatcgtaaaatagcgtgctgccaatttgctgtctggcaccgtctgcgatggcaaggttggtattggcctggatttgtaccacggttggtggaacggcgggagattttaaggagtggctggtaaatgccgttagcaggctgagcagcgccagtgaagctttcatctggttcgtccgtgaaaataagagtcacagattcgaccttccgggctaacgattgttctgtagagaaaatgtccagaagcggataaaaaattcctgaacaacgtgggagtttcagattactggcacagagtgccggatgcggagtgaacgccttatccggcctacaaaagcacgcaaattcaatatattgcagagattgcgtaggcctgataagcgtagcgcatcaggcaattttgcgttcaaactcccggacaagccgggagtttggagtaggttattcccactcttgcaggaaacgctgaccgtactggtcggctaccagcagagcggcgtaaacctgatctggcgtcgcgccgccaggcatgttgtgaatggtttcaccttctgcacatgccgcttctgccacaattcgcattttcgccgggacatcttctttaatatccagttgagcgagagttattggcaaacctaccgcatggctaagggcagctacggtttcgatttcctccaccggcgcattttccagaaccagctgcgtcagcgtaccgaatgccactttttcaccgtgataatagtgatgcgcgtccgggatagcggtcaggccgttatgcactgcgtgcgccgcagccagaccaccactttcaaaaccaacaccgctcaaataggtgttcgcttcaatcacgcgctccagcgccggagtcactacatgctgttcggcagcaagcatcgctttttcgccttcttccagcagggtgttgtagcacagttcagccagtgccagcgcagcctgggtgcacttgccgcccgccatggtggtcgcgccgctacgagagcaggcacgcgcttcaaaccaggttgccagcgcatcgccgatacccgccgctaacagacgtgcaggtgcgccagcgacgattttggtgtcgacaatgaccatattcgggttatttggcaacagcagatagcggtcaaactcaccctcatcggtgtagataacagacaatgcgctgcacggtgcatcggtagaggcgatagtcggtgcgatcgctaccggaacacccatgaaatgtgccagtgctttggcagtatcgagggtttttccgccaccgataccgagaattgcgccacactgcgcagtctccgcgatgccacgcagacggtcgatctcattttgcgaacattcaccgccaaacggcgcaatttctactaccagtccagcatctttaaagcttttctcgacagtggattgagcaaaacctaaaacaaatttgtcacccaccactaaccagcgttctgccagcggcttcaggtattcgcccagacgattaatcacatcagcgccctggatgtatttacccggtgattgaataatgcggtccataattgctcctttagagatgagtagtgccaaatgcggcattccagtcgtgttcgaacttctctatagctgactctaccgcaggggtgttgagcatttgttgcgctacatctaagggcagggtgatggattcacatcctgccagtaaacagtccagcgcctgacgcggcgttttaaagctggctgccagcaccatgctttctggcgcgtgcatttctaacagcgtttgcagctcctgaaccgtacgaatgccgtctccgccctgggcatctacgcggttaacatacggagcaacgtattttgcccctgccagtgcggctaataacccttgtgcggcgctatatacagcagtgccaagtgtagtaataccctcttttttcagtattttaattgctgccagaccttcggaagtcaccgggattttcaccacaatacccggaatagcgtcgcgcaggcgcttcgcttcttccaccatcccctgcgcgtcgcggctcatggtctgagcaaacagaatgccctcatcaccaatcgctttttgcagacgcggcagcacttcccatatggactccttgctggcagcgataatgctcgggttagttgtcaccccggcaatggggaatatgcgtgccagacgttcgacttctgcgacgttagcggtgtccagatacagttccatgatgtttccttttacagttccagttcatgttgcagcaggctggcgatagcgtcggcagaggcggcgttaaccagcgcgttacggaattcttcgtgcatgatgcggcgagcgaggcgcgagaaaatgcgcatatgctgatcgcccgcagcgtgtttgttcagggttaacataatgatgaattgcgcttcatcatcgccccagcgcaccggcgcttgcagacgcgccacgctgatggtggattgctcaatgtgttctgatttgctgtgtggaatggcaaaactaaagcccagaccggtagagaaaacggcctcgcgcgcccacaagtcggcttccagtttacgcggatagcggcagcggcccgccagcagcaggttatcggtcatgcctttgagcacttcttctttgctgcgccagtcgctttccagtgtgatgcactcggcggtgaccagcggtgcgtcttgttgggtcatgcggaattgcgccagcaggtgttctacttccagcgaagtacggcaggccattgcctggttgagcaacttgcggcactcacggctatcaagttgcgccatccgagctttcgccgccggaattgatggtgcgctcatgctgagttcatccagccctaagccgaccagcaacggcagcacggaacctttcgctcccagctcaccgcacagaccaatccatttgccctggcgatgcaccgcttgcacggcgtaatcgagcgcccgcaagaatgccggattcaggctgttgtagtgacgagtaaccttagcgttatcgcgatccaccgccagcagatactgcgtcaggtcattactaccaatactaaagaaatcaatctcttcgcagcattgatcgatgatgaacatcaccgacggcacttccagcatgatgccgagctggattttctcatcaaacggaatgtgttcgttacgtagttgctgtttggcttccgccagtttttctttcacccataagatctcttccattgaggagatcatcgggatcatgattttcaggctgccgtgagcggaggcgcggaggatcgaccgtagctgcgtggtaaacaacgacgcgtactcttcataaatacgcacggcgcgataaccgaggaacgggtttgcctctgcgggaatgttcagataatcaacgggtttgtcgccgccaatgtccatagtgcgcacaataatgctgcgtccgttggcggattccagcgcctgacaaaaaatgttgtacaactcgctttcgcccggtgcgctggtgcgatccatatagagcatttcagtgcggaacaaaccaacgccttccgcaccattgccgaatgcggcctgcgcttccacggagtgagcgatgttagcggcaatttcaatgcggataccgtcagcggtacgggcttgttgggtcagccagacacgctgttgctcacgcagggcgtcctgtacgcgggcttcttgctgataataacgagctacggcttcccctggctcaaccacaatcgccccggcgttgccgtcgatataaatcgtttgttgctgccacggagtaagggcatcaatatccacaccaaccagcgttggaatgttgaacgaacgggcaaggatcaccgtatgtgaggtggtgccgccgcttttgagcaacaatcctttgaggtgatttttatccagttcgaggaactggctgggggtcagttcatcagccatacaaatggcgggctgcgtcagtttgcccggtgccgggaagcgttgctcaccgtagatttgctggagtaactggaagcagacgtcgcgtacgtccagggcacgttcttgcaggtagctgctgctggaacgggaaaactcttcgcaaaagtgattcgcgctggcaacaattgcttcggcgcagcttaatccggcgctgacgcctgccagtaaatgttcgcgcagggaagtatcgccagccagggatcggtgagcttccagaatcgcgctggtagcaccgtcgctatccagcagacgaaactcaatgtttttcagtaccagcgtcaggccgttttccagtgcggattgctcggcgtcaacgcctttggctgcgggaagattacccagcgcattgagatctaaagaagagatcggcgtcagaatgccgcctgcactaccgctgcacacggtgcgggcgcggataatttgcggattcagattggtcagtgaaaccggcagtggttccagttcgtcagatttaacttccgccagcggcgcatcgcagtgggggaattcatcgcgcagccattggcttaaacgctggtgcgcttcctgttcgtcggccccggaaatcagtaactggcagttatcgcccgccagcgtatcggtgccaatcagcgcaagggcgcttttggcgttgcccttgcggtcagtgcgcaggttatgccactcaatttgtgatgaaaaagtattacacagcgtttcaacgtggcttgccggacgcgcatgtacgccgttaggtagctcacaaataaattccacaatcagggccattgcctctctcccggtacggttttctgtttacaggataagagcgcacggcaacggcctgccatgtgacaaatctgccaaaagctggacaaatgtaatgtaaccgtcaatttgcgacgcgtctcacaagacgctgttttgcggcatgcttccggtttatcgcaagttatgaggcggatcgcatttttgtactgatattacaaaagtccagtaaatggcctttttatccactgtttgctccgcctgcgattgcctattgtttcctccatcaaaaatatggacatgggctttcgcaagcccgggagcagcttatgaatgagttggtgcagatcctgaaaaatacccgtcagcatttaatgacgggcgtttcacacatgattcccttcgtggtatcgggcggtattttgctggcggtttccgtcatgttgtatggcaaaggcgcagtgccggatgccgtagccgatccaaatctgaaaaaactgtttgatatcggcgttgcgggcttgacgctgatggtgcctttcctcgcagcgtacatcggttattccattgcagagcgttctgcgctggctccgtgcgctatcggtgcctgggttggtaacagctttggtgcgggcttctttggtgcactgatcgccgggattatcggcggcatcgtggtgcattacctgaagaaaattccggtgcataaagttctgcgctcggtgatgcctatcttcattattcctatcgtcggcacactgattaccgcaggcatcatgatgtggggcttgggcgagcctgtaggggcgttgaccaacagcctgactcagtggcttcaggggatgcagcagggcagcattgttatgctggcggtgatcatgggtctgatgctggcgttcgatatgggcggtccggttaacaaagtggcctatgccttcatgctgatttgcgttgctcagggtgtttataccgtggtggccatcgctgccgtgggtatttgtatcccgccgctggggatggggctggcgacgctgattggtcgtaaaaatttctccgcagaagagcgcgaaaccggcaaagcggcactggtgatgggctgtgttggcgttactgaaggggcgattcctttcgccgctgccgatccgctgcgtgtcattccttccatcatggtcggttcagtttgtggtgcagtaactgcggcgctggtcggtgcgcagtgctatgcaggctggggtggtctgattgtgctgccggtggttgaaggcaagctgggttatatcgcagcagtggctgtcggagcagtggtgacggctgtttgtgtgaacgtgctgaaaagtctggcgcgtaaaaatgggtcttcgactgatgaaaaagaagacgacctggatttggattttgaaattaattaattgaggaacgagccatgacgaaaattattgcagtaaccgcatgtccttcaggtgttgcccatacctatatggcagcagaggcgctggaaagtgccgcgaaagcgaaaggctgggaagtgaaagtagaaacccaggggtcaattggtctggaaaatgaactgactgcggaagatgtggcgagcgctgatatggtgattctgaccaaagatatcggcatcaagtttgaagagcgttttgctggcaagaccatcgtgcgcgtcaacatcagcgatgcagtaaaacgtgctgacgccattatgagcaaaattgaagctcacctggcgcaaaccgcttaagttcttctcccgctcgcaagggcgggttcgctttcccacaggagttcctcatgacgaatcgtatctctcgcctcaaaactgcactgtttgccaatacccgtgaaatctcgctggagcgggcgctgctttataccgccagccatcggcaaaccgaaggcgaaccggtgatattgcgccgggcgaaagcaacagcgtatatccttgaacatgttgaaatttcgattcgtgatgaagaactgattgccggtaaccgcaccgtaaaaccgcgcgccgggattatgtcgccggaaatggacccttactggctgctgaaagagctggatcaattcccgacgcgtccgcaggaccgctttgctatcagcgaagaagataaacgtatctaccgtgaagagttgttcccgtactgggaaaaacgttcgatgaaagatttcatcaacgggcagatgacagatgaagtaaaagccgcgaccaacacgcagattttcagcatcaaccagacggataaaggccaggggcacattattattgattacccacgcctgttgaatcacgggctgggtgagctggtggcacagatgcagcaacattgtcagcaacagccggagaatcacttttatcaggccgcgttgttactgctggaagcctcgcagaaacacattttgcgttacgccgaactggcggaaacgatggcggcaaactgcacagatgcccagcgtcgcgaagagctgctgactattgcagagatctcccgccataacgcgcaacataagccgcagacgttctggcaggcgtgccagttattctggtacatgaacatcattctgcaatacgaatccaacgccagttcgctatcgttggggcgcttcgaccagtatatgttgccgttctatcagacatcattaacccagggcgaagatgcggcgttcctgaaagaactgctcgaatctttatgggtgaaatgcaacgacatcgtgctgttgcgctccaccagtagcgcgcgttatttcgccggtttcccgaccggctataccgcactgctcggcgggttaaccgagaacggacgtagcgcggtgaacgtgctttcgttcctttgccttgacgcctatcaaagcgtgcaattaccgcaaccgaacctcggcgtgcgcactaacgccttgatcgacacgccgttcctgatgaaaaccgccgaaaccattcgcttcggtaccggtattccgcaaatctttaacgatgaagtggtggtgccagcgttcctcaaccgtggcgtttcgctggaagatgcgcgcgactattccgtagtgggctgtgtggaattatctattcccggcagaacctacggcttgcatgacatcgcgatgtttaatctgctgaaagtgatggaaatctgcctgcatgaaaatgaaggcaatgctgcgctgacttatgaaggtttactggagcagatccgcgccaagatcagccactacatcaccctgatggttgagggcagcaatatttgtgatatcggccatcgcgactgggcacctgtaccgctgctctcatcgtttatcagcgattgtctggaaaaaggccgcgatattaccgatggcggcgcgcgttataacttctccggcgtacaggggatcggtatcgccaacctgagcgattctctccatgcgttgaaagggatggtttttgagcaacagcgtttaagttttgacgaattgctgtcggtattaaaagccaacttcgcaacgccagaaggcgaaaaagtccgcgctcgcttaattaaccgcttcgagaaatacggtaacgatatcgacgaggtggataacatcagcgccgaactgttgcgccactactgcaaagaagtggaaaaataccagaacccgcgcggcggctacttcacgccgggatcgtataccgtttctgctcacgtcccgttgggatcggtggttggcgcgacgccagacggtcgttttgccggagaacagctggcagacggcggcttgtcacccatgctgggccaggacgcacaagggccaacagcggtactgaagtcagtcagtaagctcgataacacgctgctgtctaacggtacgttgctgaacgtgaaattcactccggcgaccctggaaggtgaagcaggattacgcaaactggccgacttcttacgggcgtttacccagcttaagttacaacatattcagtttaacgtggtgaacgccgacacgttgcgggaagcgcaacagcgcccacaagattatgccgggctggtggtgcgcgttgccggatacagcgccttctttgtcgaactgtcgaaggagatccaggatgacatcatccgccggacagcgcatcagctgtaacgttgtggaaacgcgccgcgatgatgtggcgcgcattttcaacattcagcgttattcactgaatgacggcgagggcattcgtacggtggtcttttttaaaggctgtccgcatctttgcccgtggtgtgctaatccggagtcgatctccggcaaaatccagacggtacgcagagaggcgaaatgtctgcactgtgcgaaatgtttgcgtgatgcggatgaatgcccctccggggcgtttgaacggattggtcgcgatatcagccttgacgctctggaacgggaagtgatgaaagatgacattttctttcgcacgtccggcggcggcgtcacgctttctggcggcgaagtgttaatgcaggcggagtttgctacccgttttttacagcgactgcggctgtggggtgtgtcatgcgccattgaaactgccggagacgcaccagccagcaagctattaccgctggcgaaattgtgcgatgaagtgttgttcgatttaaaaattatggacgcgactcaggcgcgggatgtggtgaagatgaacctgccacgcgtgctggagaatctgcgtttgctggtgagtgagggcgtcaacgtgatcccgcgtttaccgctgatccctggtttcacgctcagccgggagaatatgcagcaggcgctggatgtactgatcccgctgaatatcaggcagatccatctgttaccgtttcatcagtacggcgaaccgaaataccgcctgctggggaaaacatggtcgatgaaagaggtgcctgcgccgtcgtcagctgatgtggcaacgatgcgcgaaatggcagaacgggccggacttcaggttaccgtgggaggttaaaatggcatacctggtggcagtaaccgcctgcgtaagcggcgtggcgcatacttatatggcggcggaacggctggaaaagttgtgcctgttagagaagtggggagtcagcattgaaactcagggcgcgctgggaacggagaatcgtttagcggatgaggatatccgccgggcggatgttgctctgttgattacggatatcgagcttgccggtgccgagcgatttgaacattgccgctatgtgcaatgcagcatctacgcattcctgcgtgagccgcagcgggtaatgagcgcggtgcgcaaagtgctttctgcgccgcagcaaacccatcttattctggagtagtcggtttttctgtcagttggctgtggtactgccggcgatattccgacggcgagcgttcggtgtttttacgaaacagacggcagaagtagttgctgtcgacaaagccgcaggcgtgcgccacttcttttaccttcaggtcatagcctttcaataacgtcttagcgtgctccagtcgcgtgtgattcaggtattcgttaaaaccaatggcccccgttttttgaaacaggtgcgagaggtaatttggcgaaatataaaacgcctgtgcaacagattcgcgggtaagcgcggaggcatagcgttcgtcgatataatcgcgaatagcttcaaatagtgcctggctgcgtgaggcggtctggatttggctgccaagcaaatcgcggcagtggctaagcaggctggcgacgataagccttgccgtttgctgctcctgcggctgcatttgcatttcattgagcgtttgtagcagaaaagaacctatgcgtgggccgcgtcgggcgacgtgttgcttcgccagattttgatattgtttgccatcccattgcacgacgctgaagccgagttgctgtttgccaaacagcacgctaaaggtagtagcgggggcttgccattgtggaaaattccagccaccagcaggaacgtacagcacatcgccgggaactaacgttgctccagcgccggtatcaacaaactcaccttccagcacaatttccagccgtggaaaatcgacctgatacgcaagatcgggcaccgggccgttactgctggcaaagtaaatctggcgcagggacagcgggccgttgatcaggcgggagagcagatagctgacgtcgtgatacatgttattcccttaggtatgtagacgggaaaacagtaactggcattattaaaaaaggccacctgaaaagtgtggcctgaggggagttcgatgtaaacattgcggcagttgtattgccggatgtggcgtaaacgccttatccagcctaccgccgcgatctgtaggccggataagacgcgtcaagcgtcgcatccggcaaatagcgcctggctgataattactgattacccacctgatcgccatagggcagtgtgtcgtaatcgatcagtgcgtttttcttatacgggttaccaatccagcgggtagtttctttgaactgcggattcaccactgaacgggttggatcgtaaccgtcgtaagataagcccgccaaatctgaccaggtgtggatcagttccgccaggctgtatttacgatcaacatcctgcgagaaatcacggggatgagtcgcttgccatttttctgacgtccacagcaggaacggaatggtgtacatatgacgcgtcgggttgtcctcattacgcccctgagttttgtgcggcggcgtgtcgtaaacctcttcaccgtggtcagagaaataaaccaggaaaccgttcgggtttgctgctttaaagtctttaatcaggctggcaaccacatgatcgttatacaggttagcgttgtcataatcgttatatgactccagctcttccgcgtttaatcccggcggaacatgatcggtattgccatcaaacttgccctgattttccgggtagcggtatttgtatttgatatgcgtacccagcagatgaacaatgatcagtttcttcggcgcagggtcattcagcacttcctggaacggcttcagcacgttggtgtcgtattcacgcgcactctgcgtacgttgctggttcatgtagtactgcttgtcggtctggcgcgaaaataccgtcagcatggtattgcgggcggtcatcgtctgctggttggtgatccagaaggttttataacccgcctgtttcatcatgttcatcagcgacggctgcgtcagatacagatccgggttcttttcattggcaaaggtcagcgcctgttgcaggatttcaatggtgtacggacgagacgtaactacgttattaaacacggtcagattcggatcggttttatgcagcgcatccagctccggcgtggtttcacgcggataaccgtacagactcatgcgtccgcgctgggtcgactcgccaatcaccagcactaaagtgcgcggttcgttacccgattcatctttgaaattagccagtggcggcaaggcattattttcattcagtaactttgttagcgagtttagttgctgacgatactgataatagccggtcaggaattgccacggtgcggcaggctccatacgcgaggccaggttatccaacgttttctcaaacggcttgtttttgataaacgtattcatggcgatcggatgcagaatcaagccataaagcagggcaaaagagacaacataacgccacggctttggaatatagaccgggcgcaggcgtgtccacagcagaactgccaccgccgtataggccagcgcgataagcacaattttcaggctgaaatactggcttaaatactcgctggcttcgttggtgttggtttcgaacatcacaaacagaacgctctgcgagaactcctgaccgtagatgacgtagtagcacagcgccgccagagaggccgcccatagcaccacgccgattactgcggcaataattttaatccgcttcggaaagaggaataccgggatcaaccacagcgaactgaataacagcgagtcgcgaatgccgttagtgccactataaccactgatgtaaataatggcctgtagcagagtagagaaaaaccaaaagtagagcagtgcccaacccagggctttccagctaaaaagaggtttagcctggacttctgtggaatgcatagtaagaacctgtcttgaaaaaatatcgccgaatgtaacgacaattccttaaggatatctgaaggtatattcagaatttgaataaaatgcagacagaaatatattgaaaacgagggtgttagaacagaagtatttcagaaaaccctcgcgcaaaagcacgagggtttgcagaagaggaagattagccggtattacgcatacctgccgcaatcccggcaatagtgaccattaacgcttgttcgacgcgaggatccggttcctggccttctttttctgcctggcgggagcggtgcagcaactcggcctgcaatacgttcagcgggtcggtgtaaatattccgtagctgaatagactctgcaatccacggcagatcggccatcagatgggaatcgttggcaatcgccagcaccactttgatgtcttcttcttgcaggttgcgtaactctttacctaacggccacagtgctttgtctaccaggcgttggtcatagtattccgccagccacaggtctgctttggcgaagaccatctccagcatgccgagacgcgtcgagaagaatggccaatcgcggcacatagcctccagctcgctctgtttgccgtcttcgaccactttttgcagcgccgtacctgcacccagccaggcggggagcatcagacggttttgcgtccaggcgaagatccacggaatggcgcgtagtgactcgacgccgccggttgggcgacgtttcgccggacgtgaacccaacggcagtttgcccagttcttgttccggcgtagcggagcggaagtaaggcacaaaatctttgttttcacgtacgtagccgcggtagacatcgcaggagatgactgacagttcatccataatgcgacgccagctctctttcggctccggcggtggcagcaggttggcttccagaatcgccccggtataaagcgacaggctgctgacggtgatttctggcagaccatatttaaagcggatcatctcgccctgttcggttacgcgcaggccgcctttcaggcttcctggcggttgtgacagcagcgccgcatgagcaggtgcgccgccgcgaccaatggaaccgccgcgaccgtggaacaacgtcagctcaatacccgctttttcgcaggttttgattaatgcatcctgtgcctgatattgcgcccaggaagctgccatcactcccgcatcttttgctgagtcggaatagccaatcatcaccatctgtttgccctgaatcaggccacgataccagtcaatattgagcagctgggtcatgacatcgttggcgttgttcagatcatcgagggtttcaaacagcggagcaaccggcatcgcaaacccgatacccgcttctttcagcagcaggtggacagccagtacgtcggacggcgttttcgccatcgagatcacgtaggcggcaatggagccttgcggtgcttcggcaatcacctggcaggtatcgagcacttcgcgcgtttcggcgcttggttgccagttgcgcggcagaagcggacgtttggagttcagttcgcggatcaggaacgcctgtttgtcggcctctgaccagctttcgtagtcgccgataccgaggtagcgggtcagctcgcccagcgcttcggtatgacgcgtgctctcctgacggatatcaatacggaccagcggtacgccgaaacatttcacgcggcgcagggtgtcgagcagatcgccgttggcgataatacccatgccacacgcctgaagtgactggtagcaagcgtagagcggttcccacagttcttcgttttgtgtcagcaggccttctggttttggcagttcttcgcctttcaggcgcgcttccagccatgcctgtgtcgccatcaggcgagaacgcaggtttttcatcagatagcgatacggttctgcggcaccttcttcgccaaccagcgccagcagttcaggggtcgcttcaaccatcgacagttcagaaaccagcacctgaatatctttcaggaacaaatcggtggctttccagcggctgagtagcaggacgtggcgggtgatatcggcagtgacgttcgggttgccgtcgcggtcgccgcccatccacgaagtaaaacggaccggaacaaattcgacgggcagtttgtagccgaggttctcttccagttgttcgttcagttcgcgcaggtaatttggtacgccttgccacaggctgttttccactacggcaaagccccatttggcttcatctaccgggcttggacgcagcttacggatttcatcggtatgccatgactgggcgatcaactggcgcaggcgacgcatcagctggttgtgttcgtagtcagcgatatctttgttatcgagctgttttaaacaggcgttcacttccaccattttgtggatcagtgtacgacgggtaatttcggttgggtgagccgtgaggaccagttccagcgacagcgattccactgcttttttgatggtgtcttcgctcagttccggctggtttttcagtttacgcagggtgcgggcgatcacttccgggttgctggcagcttcgcctttcggcgaaatgctgtggtattgctcggcggtgttggccaggttcaggaactgactaaacgcacgcgcaacgggcagcagctcgtcgttcgacaaattttgtaaggtggtgagcaactcctggcggttagcatcattgccagcgcgtgaagatttcgacaacttacggatagtttctacgcgttcaagaatgtgttctcccaacgcatccttgatggtttctcccagcactttgccgagcatactgacattactacgcaatgcggaatattgttcgttcatattaccccagacaccccatcttatcgtttgatagccctgtatccttcacgtcgcattggcgcgaatatgctcgggctttgcttttcgtcgtcttttataaagccacgtaaaagcggtgacgtcaaatgctgcgaaatcgcttcagcaaacgaataaatagcaggaatttacgtcattaaattcacgacgctttaaataagcgtaacttatggaaatgttaaaaaatcgccccaagtaacaccaaaggtgtaggtcggataagatgcgcaagtatcgcatccgacattattgcggcactggagtttggcaacagtgccggatgcggcgcgagcgccttatccggcctacagttgggcatcgtttgagtcactgtcggtcggataagatgcgcaagtatcgcatccgacattattgcggcactggagtttggcaacagtgccggatgcggcgcgagcgccttatccggcctacggttgggcatcgtttgagtcactgtaggtcggataagatgcgcaagcatcgcatccgacattattgcggcactggagtttggcaacagcgccggatgcggcgcgagcgccttatccggcctacgttttaatgccagcaaaaatggtgaattacctgggttatcagttcgcgggtgggcttgataaaccgtgtttccagatattcatcaggttgatgagcctgattaattgagccaggccccaacaccagcgtcgggcataacgtttgaataaacggcgcttcggtacagtagttcaccacttcggtttttgctccgagcaatttctcaaccacttcaaccagttgatgattcggtgggcattcatagccagggatcggcggatgcagctcgtcgaccgtcagacgacccggccagcgttcgctcaccggagccaatgcatcgttgagcaaaccattaagttcattgagtgtcatgccaggcagcggacgaatatccatatgcaactcacagcaagcgcaaatacggttagaagcgtcgccaccgtgaatatgcccgaggttgagcgtagggtatggcacggtaaacgcttcgtagtgataacgttctttcaggttatcgcgcaattgcaaaatatgcccgatggcgtcgtgcattagttcgatagcgttaactccgcgtgctggatcgctggagtgccccgactggccctgaatacggatggcgttagagatatgacctttatgtgcgcgtaccggttgtagtgacgtcggttcgccaatgatggcgcaatccgggcgcagggcggtagtttcggcaaaataacgcgctccggccatactggtttcttcatcagcagtcgccagaatgtagagcggttttttcagtttcgtgacgtcgacatcgcgtagcgcatcaaggataaacgcaaaaaagcctttcatgtcggcggtgcctaagccgtaaagcttgccgtcatgctccgtcagtgtaaacggatcgcgcgtccagcgaccgtcatcaaatggcaccgtatcggtatgccccgccagcaacaagccgccagccccctgtccgatacttgccagcatattgaatttgttgcgagttcctggaacaggctgcacttccacattgaagcccaaatctttaaaccagtccgccagcagagtgattaaatctgcattgctttgatcgagtgcctcttccgtggcgcttattgaaggtgtggcaatcagagcgcggtaaatctcgataaatggcggtaatttgtttttcattgttgacacacctctggtcatgatagtatcaatattcatgcagtatttatgaataaaaatacactaacgttgagcgtaataaaacccaccagccgtaaggtgaatgttttacgtttaacctggcaaccagacataagaaggtgaatagccccgatgttgaatacgctgattgtgggtgccagcggctacgctggcgcagagctagtgacctatgtaaatcgccatccgcatatgaacataaccgctttgactgtttcagcgcaaagcaatgatgcgggaaagttaatctccgatttgcatccgcagctaaaaggcatcgttgatctgccgttgcagccgatgtcggatatcagcgagtttagcccaggggtggacgtagtgtttctcgccaccgcccatgaagttagccacgatttagcgccgcagtttcttgaagcgggctgcgtggtgttcgacctttccggcgcgtttcgtgttaacgacgccaccttctatgaaaaatattacggctttacccatcaatacccggaactgttggaacaggcagcctacggtctggcggagtggtgcggtaataaattaaaagaagcgaatttgattgcggtgccgggctgttatccgacggcggcacagctggcgctgaaaccgttgattgatgccgatcttcttgacctcaatcagtggccggtgatcaacgccaccagcggcgtgagcggtgcagggcgtaaagcggccatttcaaacagcttttgtgaagttagcctgcaaccgtatggcgtctttactcatcgccatcaaccagagatcgccacacacctcggtgctgacgttatcttcaccccacatctgggcaatttcccgcgcggcattctcgaaaccattacctgccgcctgaaatcgggtgtgacccaggcgcaagtcgcgcaagtgttacagcaggcgtatgcccataaaccgctggtgcggctgtatgacaaaggcgttccggcgctgaaaaatgtcgttgggctgccattttgcgatatcgggtttgccgttcagggcgagcatctgattattgtggcgaccgaagacaacttactgaaaggcgcggcggcacaagcggtacagtgcgccaatattcgtttcggctatgcggaaacgcagtctcttatttaagggtgcaatgatgaatccattaattatcaaactgggcggcgtactgctggatagtgaagaggcgctggaacgtctgtttagcgcactggtgaattatcgtgagtcacatcagcgtccgctggtgattgtgcacggcggcggttgcgtggtggatgagctgatgaaagggctgaatctgccggtgaaaaagaaaaacggcctgcgggtgacgcctgctgatcagatagacattatcaccggagcactggcgggaacggcaaataaaaccctgttggcatgggcgaagaaacatcagattgcggccgtaggtttgtttctcggtgacggcgacagcgtcaaagtgacccagcttgatgaagagttaggtcatgttggactggcgcagccaggttcgcctaagcttatcaactccttgctggagaacggttatctgccggtggtcagctccattggcgtaacagacgaagggcaactgatgaacgtcaatgccgaccaggcggcaacggcgctggcggcaacgctgggcgcggatctgattttgctctccgacgtcagcggcattctcgacggcaaagggcaacgcattgccgaaatgaccgccgcgaaagcagaacaactgattgagcagggcattattactgacggcatgatagtgaaagtgaacgcggcgctggatgcggcccgcacgctgggccgtccggtagatatcgcctcctggcgtcatgcggagcagcttccggcactgtttaacggtatgccgatgggtacgcggattttagcttaagttttgttggccggaggcgcagctttccggcattgaatttcaaaataaggaaacagagttatggcactttggggcgggcgttttacccaggcagcagatcaacggttcaaacaattcaacgactcactgcgctttgattaccgtctggcggagcaggatattgttggctctgtggcctggtccaaagccctggtcacggtaggcgtgttaaccgcagaagagcaggcgcaactggaagaggcgctgaacgtgttgctggaagatgttcgcgccaggccacaacaaatccttgaaagcgacgccgaagatatccatagctgggtggaaggcaaactgatcgacaaagtgggccagttaggcaaaaagctgcataccgggcgtagccgtaatgatcaggtagcgactgacctgaaactgtggtgcaaagataccgttagcgagttactgacggctaaccggcagctgcaatcggcgctggtggaaaccgcacaaaacaatcaggacgcggtaatgccaggttacactcacctgcaacgcgcccagccggtgacgttcgcgcactggtgcctggcctatgttgagatgctggcgcgtgatgaaagccgtttgcaggatgcgcttaagcgtctggatgtcagcccgctaggctgtggcgcgctggcgggaacggcctatgaaatcgaccgtgaacagttagcaggctggctgggctttgcttcggcgacccgtaacagtctcgacagcgtttctgaccgtgaccatgtgttggaactgctttctgctgccgctatcggcatggtgcatctgtcgcgttttgctgaagatctgattttctttaacaccggcgaagcggggtttgtggagctttctgaccgcgtgacttccggttcatcattaatgccgcagaagaaaaacccggatgcgctggagctgattcgcggtaaatgcggccgggtgcagggggcgttaaccggcatgatgatgacgctgaaaggtttgccgctggcttacaacaaagatatgcaggaagacaaagaaggtctgttcgacgcgctcgatacctggctggactgcctgcatatggcggcgctggtgctggacggcattcaggtgaaacgtccacgttgccaggaagcggctcagcagggttacgccaacgccaccgaactggcggattatctggtggcgaaaggcgtaccgttccgcgaggcgcaccatattgttggtgaagcggtggtggaagccattcgtcagggcaaaccgctggaagatctgccgctcagtgagttgcagaaattcagtcaggtgattgacgaagatgtctatccgattctgtcgctgcaatcgtgcctcgacaagcgtgcggcaaaaggcggcgtctcaccgcagcaggtggcgcaggcgattgcttttgcgcaggctcggttagggtaagaacatttatatgtataaatttgagcctggcttatcgccgggcttttttatggcaaaaaaaagcggatcctggagatccgcaaaagttcacgttggctttagttattcgagttgagaaactctcgaaacgggcagtgacttcaagggttaaaagaggtgccgctccgtttctgtgagcaattatcagtcagaatgcttgatagggataatcgttcattgctattctacctatcgccatgaactatcgtggcgatggaggatggataatgaatattcgtgatcttgagtacctggtggcattggctgaacaccgccattttcggcgtgcggcagattcctgccacgttagccagccgacgcttagcgggcaaattcgtaagctggaagatgagctgggcgtgatgttgctggagcggaccagccgtaaagtgttgttcacccaggcgggaatgctgctggtggatcaggcgcgtaccgtgctgcgtgaggtgaaagtccttaaagagatggcaagccagcagggcgagacgatgtccggaccgctgcacattggtttgattcccacagttggaccgtacctgctaccgcatattatccctatgctgcaccagacctttccaaagctggaaatgtatctgcatgaagcacagacccaccagttactggcgcaactggacagcggcaaactcgattgcgtgatcctcgcgctggtgaaagagagcgaagcattcattgaagtgccgttgtttgatgagccaatgttgctggctatctatgaagatcacccgtgggcgaaccgcgaatgcgtaccgatggccgatctggcaggggaaaaactgctgatgctggaagatggtcactgtttgcgcgatcaggcaatgggtttctgttttgaagccggggcggatgaagatacacacttccgcgcgaccagcctggaaactctgcgcaacatggtggcggcaggtagcgggatcactttactgccagcgctggctgtgccgccggagcgcaaacgcgatggggttgtttatctgccgtgcattaagccggaaccacgccgcactattggcctggtttatcgtcctggctcaccgctgcgcagccgctatgagcagctggcagaggccatccgcgcaagaatggatggccatttcgataaagttttaaaacaggcggtttaaaccgtttaacgcagctacccgataggcttccgccatcgtcgggtagttaaaggtggtgttgacgaagtactcaatagtgttgccgccacctttctgttccataatcgcctgaccgatatgaataatttcggcagcgcgctcgccaaagcagtgaatacccagaatctcttttgtttcccgatggaacaaaattttcagcgtgcccacgttcatgccgacgatttgtgcgcgtgccagatgtttaaactgggcgcggcccacttcatatggcactttcattgcggtcagctgctgttcggttttgcccacagagctgatttccgggatggtgtaaataccggtagggatatcttcaatcagatgtgcggtggcttcgccttttaccagcgcctgcgcggcaatgcgcccctggtcataggccgccgacgccaggctcggataaccaatcacgtcgcccaccgcgtaaacgtgtggctgtgcggtctgatacatgctgttgaccttcagctgtccgcggctgtcagtttctagcccaatgttctgtaacgccagcgaatcggtattaccggtgcgaccgttggcatagagcaggcagtcagctttcagttttttacccgacttcagatgcatgatcacaccatcgtcacagccttcgatcttctcgtactcttcgttgtgacgaatcactacgccactgttccagaagtgataggagagagaatctgacatctcttgatcgagaaatgccagcaggcgatcgcgggtgttgatcagatccacttttacatccataccgcggaagatcgacgcatattcacagccgatcactccagcaccatagataagtacatggcgcggttcgtggtgcatgctgagaattgagtcgctgtcgtaaatgcgtggatgggtgaaatcaacatctgttggatgatatggacgagagccgcaggcaataacaaatttttcagcggttagtgtttcaacgctgccgtccgggcaatccagcgccaacgtatgctcgtcaacaaagcgagcgtttccctgcaatatttcacagtgattacgttcgtaaaatccctgacgcatgcgcgtttgttgattaatcacgttatcggcatggttaaggatatcggcaaaagaagagcggagcagtcgggaatggtcgctgtaaagtgggttttgattgaattctataatgcggctgacggcgtgacggagagctttcgacgggatggtgccccagtgggtgcaaccgccgccaacattttgataacgctcgataactgcgacgcgcgcaccttgcttaaccaggcccattgcagcgccttcgccgccggggccggaacctattactatggcatcgtaatcgtaggaatgtggcatggtagggcttacctgttcttatacataaaagcaacagaatggtaacattttatcgcgggtaagccaattgatccccgtcatttatctggctatatcctgagcggcctttgctttgtctgtttcttacttttgccctgacgttttattggatttttatcgacgatactctccgtttaagcggcaggtttccgctgtacgtaaaagaaccggccaaagaattgcagtaaatatgttttattgcgttaccgttcattcacaatactggagcaatccagtatgttcattctctggtatagtgccagcagtacttttggcaaggattcagacatcgtgatgggcgtaagagcgcaacaaaaagaaaaaacccgccgttcgctggtggaagccgcatttagccaattaagtgctgaacgcagcttcgccagcctgagtttgcgtgaagtggcgcgtgaagcgggcattgctcccacctctttttatcggcatttccgcgacgtagacgaactgggtctgaccatggttgatgagagcggtttaatgctacgccaactcatgcgccaggcgcgtcagcgtatcgccaaaggcgggagtgtgatccgcacctcggtctccacatttatggagttcatcggtaataatcctaacgccttccggttattattgcgggaacgctccggcacctccgctgcgtttcgtgccgccgttgcgcgtgaaattcagcacttcattgcggaacttgcggactatctggaactcgaaaaccatatgccgcgtgcgtttactgaagcgcaagccgaagcaatggtgacaattgtcttcagtgcgggtgccgaggcgttggacgtcggcgtcgaacaacgtcggcaattagaagagcgactggtactgcaactgcgaatgatttcgaaaggggcttattactggtatcgccgtgaacaagagaaaaccgcaattattccgggaaatgtgaaggacgagtaatgaaacaagcaaatcaagatagaggtacgctgctgctggcgttagttgctggcttatcgattaatggtactttcgcagcgctgtttagctccattgtgccattttctgtattcccgattatttccctggtgctgacggtttactgcctgcatcaacgttatcttaatcgcactatgccggtaggcttgccgggtctggcagctgcctgttttattctcggcgtactgctgtacagcacggtagttcgtgcggaatatccggatatcggctctaacttcttcccggcagtactctccgtcattatggtgttctggattggcgcgaagatgcgtaaccgtaagcaggaagttgctgagtaatcggtattatgccggatgctggcgcatccggcatgggttttacttcgcggtcagtaatacgccgcactccatatggtgcgtgtaggggaactgatcaaacagagccagacgttcgaccttgtgcgtctggcttaatgtttccagattcttgcataacgtttccgggttacaggagatgtacaaaatacgcggatacgcctgcaccattttctcggtttcactgtccagaccgctgcgcggagggtcgacaaaaatggtttcgcactgataactctttaagtcgatcccttgcaggcggttaaactcgcgcacaccattcatcgcctgagtaaattcttctgccgccatacgaataatttgtacgttatcaatatggttagctgcgatgttgtattgcgcagcagcaaccgacggcttagcgatttcggtggctaatacccgatcaaaattacgcgccagcgctaatgaaaagttaccgttgccgcagtacagctccagtaaatcgccttttgagcctttggttacgtccagcgcccattccagcatctgaatattcatcgccgcgttcggctgggtaaagctgttttctacctgacggtagatcatctctttccctgcgaccggcagacgttcatcgatgtaatcctgatccagctcgattttggttttcgttgcccgaccaatcagatgcacattcagattctgcgcgcgcagtgcatcgcgcagggcctccgcttcctgacgccactcatcatccagcttcttatggtatagcagggaaaccaccgcctgattactcagtgtagtgaggtaatcaatctggaacaacttgtggcgcagaacgggattattacgcacacccgcaatcatcgccgtcatcaactggttgataagttcactggcggcggggaagctatccacgcggatgcggcttttggtttgttgatcgaaaatgatgtgatacaggtcatcgccatcgtgccagatgcggaactccgcgcgcatccggtaatgactgaccggcgagcgaaacacttccggaaccaggtcagaaaacggtgccatcatactttgcaaacgtaccactttttcggctaactgcgcttcatactgttctgttggaaggtgttcgggggtcatgatgtatcctgaaaaattaaagtacgcggcgattgtagggattgctcatcagatgtccagatcttgatgaattcctatttgtgagctacgtctggacagtaacttgttacaacctgtagcatccacttgccggtcctgtgagttaatagggaatccagtgcgaatctggagctgacgcgcagcggtaaggaaaggtgcgatgattgcgttatgcggacactgccattcggtgggaagtcatcatctcttagtatcttagatacccctccaagcccgaagacctgccggccaacgtcgcatctggttctcatcatcgcgtaatattgatgaaacctgcggcatccttcttctattgtggatgctttacaatgattaaaaaagcttcgctgctgacggcgtgttccgtcacggcattttccgcttgggcacaggataccagcccggatactctcgtcgttactgctaaccgttttgaacagccgcgcagcactgtgcttgcaccaaccaccgttgtgacccgtcaggatatcgaccgctggcagtcgacctcggtcaatgatgtgctgcgccgtcttccgggcgtcgatatcacccaaaacggcggttcaggtcagctctcatctatttttattcgcggtacaaatgccagtcatgtgttggtgttaattgatggcgtacgcctgaatctggcgggggtgagtggttctgccgaccttagccagttccctattgcgcttgtccagcgtgttgaatatatccgtgggccgcgctccgctgtttatggttccgatgcaataggcggggtggtgaatatcatcacgacgcgcgatgaacccggaacggaaatttcagcagggtggggaagcaatagttatcagaactatgatgtctctacgcagcaacaactgggggataagacacgggtaacgctgttgggcgattatgcccatactcatggttatgatgttgttgcctatggtaataccggaacgcaagcgcagacagataacgatggttttttaagtaaaacgctttatggcgcgctggagcataactttactgatgcctggagcggctttgtgcgcggctatggctatgataaccgtaccaattatgacgcgtattattctcccggttcaccgttgctcgatacccgtaaactctatagccaaagttgggacgccgggctgcgctataacggcgaactgattaaatcacaactcattaccagctatagccatagcaaagattacaactacgatccccattatggtcgttatgattcgtcggcgacgctcgatgagatgaagcaatacaccgtccagtgggcaaacaatgtcatcgttggtcacggtagtattggtgcgggtgtcgactggcagaaacagactacgacgccgggtacaggttatgttgaggatggatatgatcaacgtaataccggcatctatctgaccgggctgcaacaagtcggcgattttacctttgaaggcgcagcacgcagtgacgataactcacagtttggtcgtcatggaacctggcaaaccagcgccggttgggaattcatcgaaggttatcgcttcattgcttcctacgggacatcttataaggcaccaaatctggggcaactgtatggcttctacggaaatccgaatctggacccggagaaaagcaaacagtgggaaggcgcgtttgaaggcttaaccgctggggtgaactggcgtatttccggatatcgtaacgatgtcagtgacttgatcgattatgatgatcacaccctgaaatattacaacgaagggaaagcgcggattaagggcgtcgaggcgaccgccaattttgataccggaccactgacgcatactgtgagttatgattatgtcgatgcgcgcaatgcgattaccgacacgccgttgttacgccgtgctaaacagcaggtgaaataccagctcgactggcagttgtatgacttcgactggggtattacttatcagtatttaggcactcgctatgataaggattactcatcttatccttatcaaaccgttaaaatgggcggtgtgagcttgtgggatcttgcggttgcgtatccggtcacctctcacctgacagttcgtggtaaaatagccaacctgttcgacaaagattatgagacagtctatggctaccaaactgcaggacgggaatacaccttgtctggcagctacaccttctgaaccacgtcccaccgtgctggtgtttgactccggcgtcggtgggttgtcggtctatgacgagatccggcatctcttaccggatctccattacatttatgctttcgataacgtcgctttcccgtatggcgaaaaaagcgaagcgtttattgttgagcgagtggtggcaattgtcaccgcggtgcaagaacgttatccccttgcgctggctgtggtcgcttgcaacactgccagtaccgtttcacttcctgcattacgcgaaaagttcgacttcccggttgttggtgtcgtgccggcgattaaacctgctgcacgtctgacggcaaatggcattgtcggattactggcaacccgcggaacagttaaacgttcttatactcatgagctgatcgcgcgtttcgctaatgaatgccagatagaaatgctgggctcggcagagatggttgagttggctgaagcgaagctacatggcgaagatgtttctctggatgcactaaaacgtatcctacgcccgtggttaagaatgaaagagccgccagataccgttgtattgggttgcacccatttccctctactacaagaagaactgttacaagtgctgccagagggaacccggctggtggattctggcgcagcgattgctcgccgaacggcctggttgttagaacatgaagccccggatgcaaaatctgccgatgcgaatattgccttttgtatggcaatgacgccaggagctgaacaattattgcccgttttacagcgttacggcttcgaaacgctcgaaaaactggcagttttaggctgatttggttgaatgttgcgcggtcagaaaattattttaaatttcctcttgtcaggccggaataactccctataatgcgccaccactgacacggaacaacggcaaacacgccgccgggtcagcggggttctcctgagaactccggcagagaaagcaaaaataaatgcttgactctgtagcgggaaggcgtattatgcacaccccgcgccgctgagaaaaagcgaagcggcactgctctttaacaatttatcagacaatctgtgtgggcactcgaagatacggattcttaacgtcgcaagacgaaaaatgaataccaagtctcaagagtgaacacgtaattcattacgaagtttaattctttgagcgtcaaacttttaaattgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgtagtgctcacacagattgtctgatagaaagtgaaaagcaaggcgtttacgcgttgggagtgaggctgaagagaataaggccgttcgctttctattaatgaaagctcaccctacacgaaaatatcacgcaacgcgtgataagcaattttcgtgtccccttcgtctagaggcccaggacaccgccctttcacggcggtaacaggggttcgaatcccctaggggacgccacttgctggtttgtgagtgaaagtcgccgaccttaatatctcaaaactcatcttcgggtgatgtttgagatatttgctctttaaaaatctggatcaagctgaaaattgaaacactgaacaacgagagttgttcgtgagtctctcaaattttcgcaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgcgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaggtccctcgcggatggagctgaaatcagtcgaagataccagctggctgcaactgtttattaaaaacacagcactgtgcaaacacgaaagtggacgtatacggtgtgacgcctgcccggtgccggaaggttaattgatggggttagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgaccctttaagggtcctgaaggaacgttgaagacgacgacgttgataggccgggtgtgtaagcgcagcgatgcgttgagctaaccggtactaatgaaccgtgaggcttaaccttacaacgccgaagctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttcctgtcgtcatatctacaagccatccccccacagatacggtaaactagcctcgtttttgcatcaggaaagcagctatgaaccactccttaaaaccctggaacacatttggcattgatcataatgctcagcacattgtatgtgccgaagacgaacaacaattactcaatgcctggcagtatgcaaccgcagaaggacaacccgttcttattctgggtgaaggaagtaatgtactttttctggaggactatcgcggcacggtgatcatcaaccggatcaaaggtatcgaaattcatgatgaacctgatgcgtggtatttacatgtaggagccggagaaaactggcatcgtctggtaaaatacactttgcaggaaggtatgcctggtctggaaaatctggcattaattcctggttgtgtcggctcatcacctatccagaatattggtgcttatggcgtagaattacagcgagtttgcgcttatgttgattctgttgaactggcgacaggcaagcaagtgcgcttaactgccaaagagtgccgttttggctatcgcgacagtatttttaaacatgaataccaggaccgcttcgctattgtagccgtaggtctgcgtctgccaaaagagtggcaacctgtactaacgtatggtgacttaactcgtctggatcctacaacagtaacgccacagcaagtatttaatgcggtgtgtcatatgcgcaccaccaaactccctgatccaaaagtgaatggcaatgccggtagtttcttcaaaaaccctgttgtatctgccgaaacggctaaagcattactgtcacaatttccaacagcaccaaattacccccaggcggatggttcagtaaaactggcagcaggttggcttatcgatcagtgccagctaaaagggatgcaaataggtggggctgcggtgcaccgtcaacaggcgttagttctcattaatgaagacaatgcaaaaagcgaagatgttgtacagctggcgcatcatgtaagacagaaagttggtgaaaaatttaatgtctggcttgagcctgaagtccgctttattggtgcatcaggtgaagtgagcgcagtggagacaatttcatgaaggataacaccgtgccactgaaattgattgccctgttagcgaacggtgaatttcactctggcgagcagttgggtgaaacgctgggaatgagccgggcggctattaataaacacattcagacactgcgtgactggggcgttgatgtctttaccgttccgggtaaaggatacagcctgcctgagcctatccagttacttaatgctaaacagatattgggtcagctggatggcggtagtgtagccgtgctgccagtgattgactccacgaatcagtaccttcttgatcgtatcggagagcttaaatcgggcgatgcttgcattgcagaataccagcaggctggccgtggtcgccggggtcggaaatggttttcgccttttggcgcaaacttatatttgtcgatgttctggcgtctggaacaaggcccggcggcggcgattggtttaagtctggttatcggtatcgtgatggcggaagtattacgcaagctgggtgcagataaagttcgtgttaaatggcctaatgacctctatctgcaggatcgcaagctggcaggcattctggtggagctgactggcaaaactggcgatgcggcgcaaatagtcattggagccgggatcaacatggcaatgcgccgtgttgaagagagtgtcgttaatcaggggtggatcacgctgcaggaagcggggatcaatctcgatcgtaatacgttggcggccatgctaatacgtgaattacgtgctgcgttggaactcttcgaacaagaaggattggcaccttatctgtcgcgctgggaaaagctggataattttattaatcgcccagtgaaacttatcattggtgataaagaaatatttggcatttcacgcggaatagacaaacagggggctttattacttgagcaggatggaataataaaaccctggatgggcggtgaaatatccctgcgtagtgcagaaaaataagaaaggggagtattcgctcccctgcaaattatttgcgtagtctgacctcttctaccgcatgattagcacttttcgtcaggattaaactggcgcgctcacgagtaggtagaatattttgctttaagttcagccagttgatctctttccacaatgtcatggcagtcttaatcgcttcttctttagttaatttcgcgtagttatgaaaataggaatccgggtcggtaaaagccccttcgcggaatttcagaaaacggttgatataccatgtctgaagtaagtcttccggtgcatcaacatatatcgaaaaatcgacaaaatcagaaacaaatacatgatgtggatcgtgtggataatccatcccgctctgtaagacatttaacccttcaagaattaaaatatcaggctgaacaaccgttttatctccatccgggatcacatcataaataagatgtgagtaaacaggtgctgtaacgtttggcacgccggatttgagatcggaaacaaacttcaccaggcgatgcatatcatacgattccgggaagcctttcttcttcatcagaccacgttctttcagaacctgattagggtgaaggaagccatctgtagtgatcagttcaacacgacgatgttccggccaacggcttaatagcgcctgcaatacacgggcggttgtacttttccccaccgcgacactgccagcaatactgataatgtaaggaatgcgttgcccgttggtaccaagaaactgttccagaactgcctgacggcgcagattcgagcttatatagaagttcagcaaacgtgacaaaggtaaatagatctcggcaacttcttctaacgagagatcttcattaatacctttgagacgggcgatctcatcttccgataacgtcataggtacggaatcacgcagagctgcccactggttgcggtcaaactgtaggtaaggcgtcattaacgtttgctcttttatactcataagcatgtttctggcggtcatagctctatcggcaaagcgatatttgccatggcgcgtcacagttctgttgaatgggttaatgggcaggagggtaacaccagatggggaggaataataagaaaaaatctctgccaggaagctatcgttgaaaagcaatgtgacagatattccatctgataaaaagaattatggtttagcaggagcgcattgttgagcacaatgatgttgaaaaagtgtgctaatctgccctccgttcggctgtttcttcatcgtgtcgcataaaatgtgaccaataaaacaaattatgcaattttttagttgcatgaactcgcatgtctccatagaatgcgcgctacttgatgccgacttagctcagtaggtagagcaactgacttgtaatcagtaggtcaccagttcgattccggtagtcggcaccatcaagtccggtggggttcccgagcggccaaagggagcagactgtaaatctgccgtcacagacttcgaaggttcgaatccttcccccaccaccaatttcggccacgcgatggcgtagcccgagacgataagttcgcttaccggctcgaataaagagagcttctctcgatattcagtgcagaatgaaaatcaggtagccgagttccaggatgcgggcatcgtataatggctattacctcagccttccaagctgatgatgcgggttcgattcccgctgcccgctccaagatgtgctgatatagctcagttggtagagcgcacccttggtaagggtgaggtcggcagttcgaatctgcctatcagcaccacttcttttctcctccctgttttttccttctgtttattgcattcaacaagtcgggcatgttgcctggttgatgtggtgatatcaccgatttatccgtgtcttagagggacaatcgatgtctaaagaaaagtttgaacgtacaaaaccgcacgttaacgtcggtactatcggccacgttgaccatggtaaaacaacgctgaccgctgcaatcactaccgtactggctaaaacctacggcggtgctgctcgcgcattcgaccagatcgataacgcgccggaagaaaaagctcgtggtatcaccatcaacacttctcacgttgaatacgacaccccgacccgtcactacgcacacgtagactgcccggggcacgccgactatgttaaaaacatgatcaccggtgctgcgcagatggacggcgcgatcctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttacattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggccgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggtctgcgtttcgcaatccgtgaaggcggccgtaccgttggcgcgggcgttgtagcaaaagttctgagctaattgccgataacatttgacgcaatgcgcactaaaagggcatcatttgatgccctttttgcacgctttcgtaccagaacctggctcatcagtgattttctttgtcataatcattgctgagacaggctctgttgagggcgtataatccgaaaagctaatacgcgtttcgatttggtttgcctcgcgatcgcggggtgaaaatgtttgtagaaaacttctgacaggttggtttatgagtgcgaataccgaagctcaaggaagcgggcgcggcctggaagcgatgaagtgggtcgttgtggtggcattgctcctggtggcgattgtcggcaactatctttatcgcgacattatgctgccgctgcgtgcgctggccgtagtaattctgattgctgcagcgggtggtgtcgcgctgttaacgacaaaaggtaaagctaccgttgcttttgcccgtgaagcgcgtaccgaagtccgtaaggtcatttggccgactcgccaggaaacattgcacaccacgctgattgtggctgcggttaccgcagtaatgtcactgatcctgtggggactggatggtattctggttcgcctggtatcctttatcactggcctgaggttctgagatgtctgaagctcctaaaaagcgctggtacgtcgttcaggcgttttccggttttgaaggccgcgtagcaacgtcgctgcgtgagcatatcaaattacacaacatggaagatttgtttggtgaagtcatggtaccaaccgaagaagtggttgaaatccgtggcggtcagcgtcgcaaaagcgaacgtaaattcttccctggctacgtcctcgttcagatggtgatgaacgacgcgagctggcacctggtgcgcagcgtaccgcgtgtgatgggcttcatcggcggtacttccgatcgtcctgcgccaatcagcgataaagaagtcgatgcgattatgaaccgcctgcagcaggttggtgataagccgcgtccgaaaacgctgtttgaaccgggtgaaatggtccgtgttaatgatggtccgttcgctgacttcaacggtgttgttgaagaagtggattacgagaaatctcgtctgaaagtgtctgtttctatcttcggtcgtgcgaccccggtagagctggacttcagccaggttgaaaaagcctaacccagcgatcaaaaaagcggcgatttaatcgttgcacaaggcgtgagattggaatacaatttcgcgccttttgtttttatgggccttgcccgtaaaacgattttttatatcacggggagcctctcagaggcgttattacccaacttgaggaatttataatggctaagaaagtacaagcctatgtcaagctgcaggttgcagctggtatggctaacccgagtccgccagtaggtccggctctgggtcagcagggcgtaaacatcatggaattctgcaaagcgttcaacgcaaaaactgattccatcgaaaaaggtctgccgattccggtagtaatcaccgtttacgctgaccgttctttcactttcgttaccaagaccccgccggcagcagttctgctgaaaaaagcggctggtatcaagtctggttccggtaagccgaacaaagacaaagtgggtaaaatttcccgcgctcagctgcaggaaatcgcgcagaccaaagctgccgacatgactggtgccgacattgaagcgatgactcgctccatcgaaggtactgcacgttccatgggcctggtagtggaggactaagaaatggctaaactgaccaagcgcatgcgtgttatccgcgagaaagttgatgcaaccaaacagtacgacatcaacgaagctatcgcactgctgaaagagctggcgactgctaaattcgtagaaagcgtggacgtagctgttaacctcggcatcgacgctcgtaaatctgaccagaacgtacgtggtgcaactgtactgccgcacggtactggccgttccgttcgcgtagccgtatttacccaaggtgcaaacgctgaagctgctaaagctgcaggcgcagaactggtaggtatggaagatctggctgaccagatcaagaaaggcgaaatgaactttgacgttgttattgcttctccggatgcaatgcgcgttgttggccagctgggccaggttctgggtccgcgcggcctgatgccaaacccgaaagtgggtactgtaacaccgaacgttgctgaagcggttaaaaacgctaaagctggccaggttcgttaccgtaacgacaaaaacggcatcatccacaccaccatcggtaaagtggactttgacgctgacaaactgaaagaaaacctggaagctctgctggttgcgctgaaaaaagcaaaaccgactcaggcgaaaggcgtgtacatcaagaaagttagcatctccaccaccatgggtgcaggtgttgcagttgaccaggctggcctgagcgcttctgtaaactaatgcctttacgtgggcggtgattttgtctacaatcttacccccacgtataatgcttaatgcagacgtatatccgagatattcgggttgtggcaaggcggcaactgagtgagtcgccaggagcatagctaactatgtgactggtgcgaatgaaggaagccaacgccgtcacaagctgaatagcgacggatagaaaagatttgttcgttggagcctggcctatccaggcctccgtcgaagaccgcaggagtttcgcaagaaacttaatcccctgcgtagacggtgacagaacgctaagattattcttttatattctggcttgtttctgctcaccgtaattaagacgctctctccgtttggaggagtgaagtgagttccagagattttctctggcaaacatccaggagcaaagctaatggctttaaatcttcaagacaaacaagcgattgttgctgaagtcagcgaagtagccaaaggcgcgctgtctgcagtagttgcggattcccgtggcgtaactgtagataaaatgactgaactgcgtaaagcaggtcgcgaagctggcgtatacatgcgtgttgttcgtaacaccctgctgcgccgtgctgttgaaggtactccgttcgagtgcctgaaagacgcgtttgttggtccgaccctgattgcatactctatggaacacccgggcgctgctgctcgtctgttcaaagagttcgcgaaagcgaatgcaaaatttgaggtcaaagccgctgcctttgaaggtgagctgatcccggcgtctcagatcgaccgcctggcaactctgccgacctacgaagaagcaattgcacgcctgatggcaaccatgaaagaagcttcggctggcaaactggttcgtactctggctgctgtacgcgatgcgaaagaagctgcttaatcgcagttatctttttaacgcattcgcttacgtataaacttattctgatattcaggaacaatttaaatgtctatcactaaagatcaaatcattgaagcagttgcagctatgtctgtaatggacgttgtagaactgatctctgcaatggaagaaaaattcggtgtttccgctgctgctgctgtagctgtagctgctggcccggttgaagctgctgaagaaaaaactgaattcgacgtaattctgaaagctgctggcgctaacaaagttgctgttatcaaagcagtacgtggcgcaactggcctgggtctgaaagaagctaaagacctggtagaatctgcaccggctgctctgaaagaaggcgtgagcaaagacgacgcagaagcactgaaaaaagctctggaagaagctggcgctgaagttgaagttaaataagccaacccttccggttgcagcctgagaaatcaggctgatggctggtgactttttagtcaccagcctttttgcgctgtaaggcgccagtagcgtttcacactgtttgactactgctgtgcctttcaatgcttgtttctatcgacgacttaatatactgcgacaggacgtccgttctgtgtaaatcgcaatgaaatggtttaagcgtgatagcaacaggcattgcggaaagtgttccattttccggtcaacaaaatagtgttgcacaaactgtccgctcaatggacagatgggtcgacttgtcagcgagctgaggaaccctatggtttactcctataccgagaaaaaacgtattcgtaaggattttggtaaacgtccacaagttctggatgtaccttatctcctttctatccagcttgactcgtttcagaaatttatcgagcaagatcctgaagggcagtatggtctggaagctgctttccgttccgtattcccgattcagagctacagcggtaattccgagctgcaatacgtcagctaccgccttggcgaaccggtgtttgacgtccaggaatgtcaaatccgtggcgtgacctattccgcaccgctgcgcgttaaactgcgtctggtgatctatgagcgcgaagcgccggaaggcaccgtaaaagacattaaagaacaagaagtctacatgggcgaaattccgctcatgacagacaacggtacctttgttatcaacggtactgagcgtgttatcgtttcccagctgcaccgtagtccgggcgtcttctttgactccgacaaaggtaaaacccactcttcgggtaaagtgctgtataacgcgcgtatcatcccttaccgtggttcctggctggacttcgaattcgatccgaaggacaacctgttcgtacgtatcgaccgtcgccgtaaactgcctgcgaccatcattctgcgcgccctgaactacaccacagagcagatcctcgacctgttctttgaaaaagttatctttgaaatccgtgataacaagctgcagatggaactggtgccggaacgcctgcgtggtgaaaccgcatcttttgacatcgaagctaacggtaaagtgtacgtagaaaaaggccgccgtatcactgcgcgccacattcgccagctggaaaaagacgacgtcaaactgatcgaagtcccggttgagtacatcgcaggtaaagtggttgctaaagactatattgatgagtctaccggcgagctgatctgcgcagcgaacatggagctgagcctggatctgctggctaagctgagccagtctggtcacaagcgtatcgaaacgctgttcaccaacgatctggatcacggcccatatatctctgaaaccttacgtgtcgacccaactaacgaccgtctgagcgcactggtagaaatctaccgcatgatgcgccctggcgagccgccgactcgtgaagcagctgaaagcctgttcgagaacctgttcttctccgaagaccgttatgacttgtctgcggttggtcgtatgaagttcaaccgttctctgctgcgcgaagaaatcgaaggttccggtatcctgagcaaagacgacatcattgatgttatgaaaaagctcatcgatatccgtaacggtaaaggcgaagtcgatgatatcgaccacctcggcaaccgtcgtatccgttccgttggcgaaatggcggaaaaccagttccgcgttggcctggtacgtgtagagcgtgcggtgaaagagcgtctgtctctgggcgatctggataccctgatgccacaggatatgatcaacgccaagccgatttccgcagcagtgaaagagttcttcggttccagccagctgtctcagtttatggaccagaacaacccgctgtctgagattacgcacaaacgtcgtatctccgcactcggcccaggcggtctgacccgtgaacgtgcaggcttcgaagttcgagacgtacacccgactcactacggtcgcgtatgtccaatcgaaacccctgaaggtccgaacatcggtctgatcaactctctgtccgtgtacgcacagactaacgaatacggcttccttgagactccgtatcgtaaagtgaccgacggtgttgtaactgacgaaattcactacctgtctgctatcgaagaaggcaactacgttatcgcccaggcgaactccaacttggatgaagaaggccacttcgtagaagacctggtaacttgccgtagcaaaggcgaatccagcttgttcagccgcgaccaggttgactacatggacgtatccacccagcaggtggtatccgtcggtgcgtccctgatcccgttcctggaacacgatgacgccaaccgtgcattgatgggtgcgaacatgcaacgtcaggccgttccgactctgcgcgctgataagccgctggttggtactggtatggaacgtgctgttgccgttgactccggtgtaactgcggtagctaaacgtggtggtgtcgttcagtacgtggatgcttcccgtatcgttatcaaagttaacgaagacgagatgtatccgggtgaagcaggtatcgacatctacaacctgaccaaatacacccgttctaaccagaacacctgtatcaaccagatgccgtgtgtgtctctgggtgaaccggttgaacgtggcgacgtgctggcagacggtccgtccaccgacctcggtgaactggcgcttggtcagaacatgcgcgtagcgttcatgccgtggaatggttacaacttcgaagactccatcctcgtatccgagcgtgttgttcaggaagaccgtttcaccaccatccacattcaggaactggcgtgtgtgtcccgtgacaccaagctgggtccggaagagatcaccgctgacatcccgaacgtgggtgaagctgcgctctccaaactggatgaatccggtatcgtttacattggtgcggaagtgaccggtggcgacattctggttggtaaggtaacgccgaaaggtgaaactcagctgaccccagaagaaaaactgctgcgtgcgatcttcggtgagaaagcctctgacgttaaagactcttctctgcgcgtaccaaacggtgtatccggtacggttatcgacgttcaggtctttactcgcgatggcgtagaaaaagacaaacgtgcgctggaaatcgaagaaatgcagctcaaacaggcgaagaaagacctgtctgaagaactgcagatcctcgaagcgggtctgttcagccgtatccgtgctgtgctggtagccggtggcgttgaagctgagaagctcgacaaactgccgcgcgatcgctggctggagctgggcctgacagacgaagagaaacaaaatcagctggaacagctggctgagcagtatgacgaactgaaacacgagttcgagaagaaactcgaagcgaaacgccgcaaaatcacccagggcgacgatctggcaccgggcgtgctgaagattgttaaggtatatctggcggttaaacgccgtatccagcctggtgacaagatggcaggtcgtcacggtaacaagggtgtaatttctaagatcaacccgatcgaagatatgccttacgatgaaaacggtacgccggtagacatcgtactgaacccgctgggcgtaccgtctcgtatgaacatcggtcagatcctcgaaacccacctgggtatggctgcgaaaggtatcggcgacaagatcaacgccatgctgaaacagcagcaagaagtcgcgaaactgcgcgaattcatccagcgtgcgtacgatctgggcgctgacgttcgtcagaaagttgacctgagtaccttcagcgatgaagaagttatgcgtctggctgaaaacctgcgcaaaggtatgccaatcgcaacgccggtgttcgacggtgcgaaagaagcagaaattaaagagctgctgaaacttggcgacctgccgacttccggtcagatccgcctgtacgatggtcgcactggtgaacagttcgagcgtccggtaaccgttggttacatgtacatgctgaaactgaaccacctggtcgacgacaagatgcacgcgcgttccaccggttcttacagcctggttactcagcagccgctgggtggtaaggcacagttcggtggtcagcgtttcggggagatggaagtgtgggcgctggaagcatacggcgcagcatacaccctgcaggaaatgctcaccgttaagtctgatgacgtgaacggtcgtaccaagatgtataaaaacatcgtggacggcaaccatcagatggagccgggcatgccagaatccttcaacgtattgttgaaagagattcgttcgctgggtatcaacatcgaactggaagacgagtaattctcgctcaaacaggtcactgctgtcgggttaaaacccggcagcggattgtgctaactccgacgggagcaaatccgtgaaagatttattaaagtttctgaaagcgcagactaaaaccgaagagtttgatgcgatcaaaattgctctggcttcgccagacatgatccgttcatggtctttcggtgaagttaaaaagccggaaaccatcaactaccgtacgttcaaaccagaacgtgacggccttttctgcgcccgtatctttgggccggtaaaagattacgagtgcctgtgcggtaagtacaagcgcctgaaacaccgtggcgtcatctgtgagaagtgcggcgttgaagtgacccagactaaagtacgccgtgagcgtatgggccacatcgaactggcttccccgactgcgcacatctggttcctgaaatcgctgccgtcccgtatcggtctgctgctcgatatgccgctgcgcgatatcgaacgcgtactgtactttgaatcctatgtggttatcgaaggcggtatgaccaacctggaacgtcagcagatcctgactgaagagcagtatctggacgcgctggaagagttcggtgacgaattcgacgcgaagatgggggcggaagcaatccaggctctgctgaagagcatggatctggagcaagagtgcgaacagctgcgtgaagagctgaacgaaaccaactccgaaaccaagcgtaaaaagctgaccaagcgtatcaaactgctggaagcgttcgttcagtctggtaacaaaccagagtggatgatcctgaccgttctgccggtactgccgccagatctgcgtccgctggttccgctggatggtggtcgtttcgcgacttctgacctgaacgatctgtatcgtcgcgtcattaaccgtaacaaccgtctgaaacgtctgctggatctggctgcgccggacatcatcgtacgtaacgaaaaacgtatgctgcaggaagcggtagacgccctgctggataacggtcgtcgcggtcgtgcgatcaccggttctaacaagcgtcctctgaaatctttggccgacatgatcaaaggtaaacagggtcgtttccgtcagaacctgctcggtaagcgtgttgactactccggtcgttctgtaatcaccgtaggtccatacctgcgtctgcatcagtgcggtctgccgaagaaaatggcactggagctgttcaaaccgttcatctacggcaagctggaactgcgtggtcttgctaccaccattaaagctgcgaagaaaatggttgagcgcgaagaagctgtcgtttgggatatcctggacgaagttatccgcgaacacccggtactgctgaaccgtgcaccgactctgcaccgtctgggtatccaggcatttgaaccggtactgatcgaaggtaaagctatccagctgcacccgctggtttgtgcggcatataacgccgacttcgatggtgaccagatggctgttcacgtaccgctgacgctggaagcccagctggaagcgcgtgcgctgatgatgtctaccaacaacatcctgtccccggcgaacggcgaaccaatcatcgttccgtctcaggacgttgtactgggtctgtactacatgacccgtgactgtgttaacgccaaaggcgaaggcatggtgctgactggcccgaaagaagcagaacgtctgtatcgctctggtctggcttctctgcatgcgcgcgttaaagtgcgtatcaccgagtatgaaaaagatgctaacggtgaattagtagcgaaaaccagcctgaaagacacgactgttggccgtgccattctgtggatgattgtaccgaaaggtctgccttactccatcgtcaaccaggcgctgggtaaaaaagcaatctccaaaatgctgaacacctgctaccgcattctcggtctgaaaccgaccgttatttttgcggaccagatcatgtacaccggcttcgcctatgcagcgcgttctggtgcatctgttggtatcgatgacatggtcatcccggagaagaaacacgaaatcatctccgaggcagaagcagaagttgctgaaattcaggagcagttccagtctggtctggtaactgcgggcgaacgctacaacaaagttatcgatatctgggctgcggcgaacgatcgtgtatccaaagcgatgatggataacctgcaaactgaaaccgtgattaaccgtgacggtcaggaagagaagcaggtttccttcaacagcatctacatgatggccgactccggtgcgcgtggttctgcggcacagattcgtcagcttgctggtatgcgtggtctgatggcgaagccggatggctccatcatcgaaacgccaatcaccgcgaacttccgtgaaggtctgaacgtactccagtacttcatctccacccacggtgctcgtaaaggtctggcggataccgcactgaaaactgcgaactccggttacctgactcgtcgtctggttgacgtggcgcaggacctggtggttaccgaagacgattgtggtacccatgaaggtatcatgatgactccggttatcgagggtggtgacgttaaagagccgctgcgcgatcgcgtactgggtcgtgtaactgctgaagacgttctgaagccgggtactgctgatatcctcgttccgcgcaacacgctgctgcacgaacagtggtgtgacctgctggaagagaactctgtcgacgcggttaaagtacgttctgttgtatcttgtgacaccgactttggtgtatgtgcgcactgctacggtcgtgacctggcgcgtggccacatcatcaacaagggtgaagcaatcggtgttatcgcggcacagtccatcggtgaaccgggtacacagctgaccatgcgtacgttccacatcggtggtgcggcatctcgtgcggctgctgaatccagcatccaagtgaaaaacaaaggtagcatcaagctcagcaacgtgaagtcggttgtgaactccagcggtaaactggttatcacttcccgtaatactgaactgaaactgatcgacgaattcggtcgtactaaagaaagctacaaagtaccttacggtgcggtactggcgaaaggcgatggcgaacaggttgctggcggcgaaaccgttgcaaactgggacccgcacaccatgccggttatcaccgaagtaagcggttttgtacgctttactgacatgatcgacggccagaccattacgcgtcagaccgacgaactgaccggtctgtcttcgctggtggttctggattccgcagaacgtaccgcaggtggtaaagatctgcgtccggcactgaaaatcgttgatgctcagggtaacgacgttctgatcccaggtaccgatatgccagcgcagtacttcctgccgggtaaagcgattgttcagctggaagatggcgtacagatcagctctggtgacaccctggcgcgtattccgcaggaatccggcggtaccaaggacatcaccggtggtctgccgcgcgttgcggacctgttcgaagcacgtcgtccgaaagagccggcaatcctggctgaaatcagcggtatcgtttccttcggtaaagaaaccaaaggtaaacgtcgtctggttatcaccccggtagacggtagcgatccgtacgaagagatgattccgaaatggcgtcagctcaacgtgttcgaaggtgaacgtgtagaacgtggtgacgtaatttccgacggtccggaagcgccgcacgacattctgcgtctgcgtggtgttcatgctgttactcgttacatcgttaacgaagtacaggacgtataccgtctgcagggcgttaagattaacgataaacacatcgaagttatcgttcgtcagatgctgcgtaaagctaccatcgttaacgcgggtagctccgacttcctggaaggcgaacaggttgaatactctcgcgtcaagatcgcaaaccgcgaactggaagcgaacggcaaagtgggtgcaacttactcccgcgatctgctgggtatcaccaaagcgtctctggcaaccgagtccttcatctccgcggcatcgttccaggagaccactcgcgtgctgaccgaagcagccgttgcgggcaaacgcgacgaactgcgcggcctgaaagagaacgttatcgtgggtcgtctgatcccggcaggtaccggttacgcgtaccaccaggatcgtatgcgtcgccgtgctgcgggtgaagctccggctgcaccgcaggtgactgcagaagacgcatctgccagcctggcagaactgctgaacgcaggtctgggcggttctgataacgagtaatcgttaatccgcaaataacgtaaaaacccgcttcggcgggtttttttatggggggagtttagggaaagagcatttgtcagaatatttaaggaatttctgaatactcataatcaatgtagagatgactaatatcctgaaactgactgaactaattgagtcaaactcggcaaggattcgatactattcctgtgtaactttcttaaggaacgagaatgaaacaggaagtggaaaagtggcgaccttttggacatccggatggtgatattcgtgatttatcatttcttgatgctcatcaggctgtctacgttcagcatcatgagggcaaagagcctttagagtatcgcttttgggttacctactctcttcactgcttcacaaaagattatgaacatcagacgaacgaagaaaaacaatcgttaatgtaccacgcgcctaaagaatctcgtcccttctgccagcaccgttataacttagcgcgcacacacttaaaaagaactattttggcgctgccagaaagcaacgttattcatgccgggtatggtagctatgccgtgattgaggtggacttagacggaggagataaggcattttactttgttgcgttcagggctttcagggaaaagaaaaaactccgtttgcatgtaactagcgcttatcccatttctgaaaaacagaaaggtaaatcagtgaaatttttcaccattgcctacaacttattgagaaataagcagcttcctcagccctcaaaataacaaaacccaccttaaggtgggtttcgccagagaattatctctggtattcagaacgccattaccggactttgccttgaccttgcgataatcgcaggttgcgggatgtctgaatttcttcagtctgctgcatcctggaagatgagaacatgtgttcttattttcgtctctatcatagttgagtatttactctcttacaatcagatctctttcattgctcaacaggcgatggcttcagactttgcattacggaatttttaagaaaggcagggcgaaacgaggaagaagcttttcgccctggacaacattcctgctgacggcactaccataaaaaaacacaacgctttcaacaaccttgcgtttttcatcttccgtagcggctcggaataaatttacgttcttacattccgtctcatagtctttgcgaggcgcgtcccagatagctgtcccagtctttccataccggctgcaaaccctgagcggttaacgcggcagcaaccgcttccggtctgcgatcgtcgtgcggtgagaactgttccaactcggggtgattatcggcatagccacctggctgcgttttcgagaaggcgctgacgttattgatcgccagcggaataacgcgatcgcgaaaccacggtgattcccgcgtggagagtgacagttcaatctccggtgcaagcagtcggaaggcgcagatggtttgcactaactggcgttcatccataatcgacgcaggctcaatgccgccagtacacgggcgcaggcgcggaaaggagacagagtaacggctttgccagtaatgctgttgcagccatagcaaatgttcggcaaccatatagctgtcaacgcgccagttgtcggaaaggccaattagcgcgccgaggcctatcttatcaatccccgcacgccccagccgatccggcgtttccagccgccagaagaagtcctgttttttgcctttcagatgatggcgggcataagtcgcctcgtgatatgtctcctgataaaccatcacgccatccagaccaagttgctttaactcggcgtattccgtctccgccagcggttgcacttccatctgtagtgaagagaactgttcacgaagggcagggagatgacgacgaaagtaatccatccccactttcgcctgatgttcaccagtgactaacagcagatgttcaaagcccatctcccgtatagcggcactttccctggcaatatccgcttcatccagcgttttgcgcttgatgcgattactcatggaaaatccacagtacgtgcagtcgttagcgcaaagattggaaagataaagcgggacgtagaaactaactgtgttgccaaatcgctgacgggtcagacgctgcgcccgttgggccagttgttccagatagccactggcggcaggcgataacagcgccatcatgtcgtcgcgggtgagttgcgaggcatttagcgcccgctctacgtcagcagccgttttgccgttgatacgcaggcggatgtcgtcccagtccagttgtcgccagcgatcgctgaaggttttcatgccgatgcctccagaaatccggtcagcgggctggtggcatgagcaaaataactgcggctgcccggtccggactgacgtgccagtaggcctgcttctaccgccagacgaaatgccttcgccatgttgacgggatcgtccgcgacggcaatcgccgtattcactaacaccgcgtcggcccccatttccagcgcctgcgcggcatggctgggaacgccgatgccagcatcgacaaccaccggcactgtggcctgctggataataatctccagcatggcgcgggtttccagtccctgattcgagccaatcggcgcgccgagcggcatcaccgctgcacagccgacttcttccagacgtttacacaataccggatcggccccgcagtaaggcagcacgacaaatccctgttgtaccagcgtttcggcggctttcagggtttcgatgggatcgggcaacagccagcgggcgtcagggtgaatctctaattttaaccagtttgtgcctaacgcttcacgagccagatgggcggcgaaaatggcttcttccgctgttttcgccccggatgtatttggcagcagggtcacacccgccgcgataagcggttcgaggatagcgtcgttgtgctggcgcaagtcgacacgtttcatcgccagtgtcaccagctggctgccggaagcgcggatcgcctccaccatcagttgtgaagaagcgaatttccctgtgccggtaaacagatgtgaatcaaacgttttgtccgcaatacgtaacatttcaaccccctgcaataacctgaaaaagcaggatctggtcgccatcctgcacgatatgttgcgcccactgctcacgcgggacgatttgctgattaatcgccagagccgcgcccgcttgtcgttggtcgagttgctccagtagttcgtgaacagtttgcccggcggcgcactgcatcgcttgatcgttaaacaggatctgcattgcttcctccgcataccgggcaaccactggcgcggcgcaacgccaggctgcgccactggctcgatttaccgtcgaacagtcggagttctcccgcaggtgtctctataccgcttaataacttaatggcttccagtgcctgcaaagtgcccataaccccgaccaccgggccaaccacgcccgccgtgcggcagttgcgttctggctcctggttatctggccacaggcagcggtaacacccctgctcccagggcggcgtcagtaccatcaactgaccgccaaatccgaccgcgctggcggtgataagcggcgtgttgagtgccacgcaggcggcattaatctcctggcgagtcgccatattgtcggtacagtcgagcaccacatcggcccgtgcaaccgcatcttttaacgcctcacccgttaaccgttgttgtaatgctgtcagttgaatgtcgggattcaactgtgtcagtcgctgttggctgacctgcgatttcgggcgatcgatatcttcagtggtaaagaggatttgtcgttgcagattgcttaaatgcacatcgtcgtcatctgccagtaccagcgtcccgacgccagcgcccgccaggtacagcgcagcaggtgtacccagcccgcccagaccgataatcagcacctggctgtcgagcagtttttgctgcccgtccagagcgatatcgtcgagcaggatttggcggctataacgcataaagtcacggtcattcatcgccaactcctgcaatttccagcaactgtgccgttgccaaacgccagtctgcggcttgagtaatggcgctgacgacggcgatactgccgacacccgttgctatcaccgcaggcgcgcgtgccagactgataccgccaatcgccacggtgggataatccgccagtcgctcaacatgccgtgccagctgttccagcccctgcggtgcagaaggcatctgtttggtttgcgtcgggaacacatgtcccagcgcgatataagaggggcgtgctgccagcgcgacgtcgatttccatatcgtcatgtgtcgaaacgcccagccgcaggcctgccgcgcggatggcattgagatcggtggcttgcaaatcttcctgccccaaatggacgccatacgcctgatgcttgatcgccagccgccagtaatcgttgataaacaatcgcgcgttatagcggcggcccagcgcaattgccgccacgacatcggcttccacctcttcatcgcgccgatctttgatgcgtagctggagagtacgtacgcctgcatccaacagacgttcgatccactgtacgctgtccaccaccgggtacagtcctgaacgaaaaggtacaggaggaaaatcaggctgatacatcacgcttcctccttacgcaggtagatttctccgcctctggcacggaagttctccgacatatccgccattcccatttcaatagtttgcgtggcggcgtaatcacgcacttcctggctgattttcatcgagcagaatttcggcccacacatggagcaaaaatgggcgactttacctgactcttgcggcagggtttcatcgtgataagcgcgggcggtaaacgggtcgagggccagattaaactggtcttcccagcgaaattcgaagcgggctttcgacatggcgttatcgcgaatttgcgcgcccggatgccctttcgccaggtcagcggcgtgggcagcaatcttataggtgataagcccctgcttaacatcttctttattgggcagacccagatgctcttttggcgttacgtaacagagcatcgcgcagccaaaccagccaatcatcgccgcaccaatccccgacgtgaagtggtcatagcccggcgcaatatcggtagttagcggccccagagtgtaaaacggcgcttcgtggcagtgctctaactcctcggtcatattgcggcggatcatctgcatcggcacgtggcctgggccttcaatcatcacctgcacgtcatattcccaggcaattttggtcagttcgcccagcgtatgcagctcggcaaactgcgcttcatcgttggcgtcctgaatagaaccggggcgcagaccgtcgcccagcgacagcgaaacgtcataagcggcacagatttcacaaatttcgcggaagtgttgatagaggaaattttcctgatgatgggagaggcaccatttcgccataatcgaaccgccgcgagagacgataccggtcaggcgtttcgcggtcatcggcacatagcgcagcagtacgcccgcatggatagtgaagtaatccacaccttgctcggcctgttccagcagcgtgtcgcggaacgcttcccaggtaagatcttcggcgatcccgttaaccttctccagcgcctggtagatcggcactgtaccgatcggcaccgggctgttacgcaaaatccactcgcgggtttcgtgaatatagcgaccggtggagagatccatcaccgtatccgctccccagcgcgtggaccataccagcttttccacttcttcttcgatggaagaggtgaccgccgagttgccgatattggcgttaacttttaccaggaaattgcgaccaataatcatcggctccgattccggatgattaatgttggccgggataatcgcacgtccggcagcaacttcatcacggacaaattccgcagtgatattttccggcagatgtgcgccaaagctcattcccggatgctggtggcgtaaaacctcgctacggatgcgctcgcggcccatattctcgcggatggcgatgaattccatttccggcgtgatgatgccctggcgggcgtagtgcagttgggtgacacggcgtcctgctttggcgcgttttggtgttagtacgccgctaaaacgcagttcgtcgaggccatcatctgccagccgcgctttagtgtaatcggaactgcgcacggtaagttcttcggtatcgccgcgcgcatcgatccacggctggcgtagttttgccagcccttgctgcacgttaatggcaatctgcggatcaccatacgggccggaggtgtcgtagaccggaatcgcttcgttttcttcgtactgcggctgttctttgctaccgccaattagcgtcgggctaagctggatctcacgcatcggcacgcgcacgccggggtgtgtgccagtgatataaatgcgttttgagttgggaaaggcggtgccttccagggtgtcgataaaatgttgggcccgggcgcgttgttcgcggcgggtcagttttgttgcagacatagctcattccaaaaagttaaggacgtggcttgtcagacgacggatgaagcaagagacgatcgccgcaggggcgatgcgatagcagattaactcttgttcccttcgcaggtattagcctgatcaggttccgcggatcccgaataaacggtctcagccagttaaggcactccgacaagaaattagccccgcaaatggggcattgaatgtaaattacgcgttaacagcgcagaactcaagcaggatgtttgacgcgggcggcgtcaagcaccagcagaatcagcttatcttccagcacaaagcgcgcttccagcgcctcgccgatgtcagataaaacctgttgaaactcaaggtaattatcatgatcgatggcggtttccagactggaatcgtagtaatccataatctgttgagtattggcttcgagttgcggccaaatcttcgcggcgcgcgcgagttgcccgttgccttccagcttatgaagaatgcgctcataaatactgaaatgtccggcagacaagtaatcgaccaggctctgacaaaaatcatcaagggctttttcgtttagcctcatgtacgattctttgccaggcttaatgccaaccagattgtagtaagccacgagcagatgcttacgtacatgtagccagcgatcaaccagtttgttacttcctctgacgcgctccgtcaggttatcgagctggttaagcatgattgactccgcaagtttgtattcaaaaactgctcagtgagaaatgtaaaaaccatgttaaacatgccagtgatgcaaaggtagtgcaagagctatggatcgtataattgaaaaattagatcacggctggtgggtcgtcagccatgaacaaaaattatggttgccgaagggagaattgccatatggcgaagcggcaaatttcgatcttgtgggtcagcgcgcactacaaatcggcgaatggcagggggaacctgtttggttagtacaacagcagcggcgtcacgatatggggtcggtacgtcaggtcattgatctcgatgttgggctgtttcaactggccggacgaggcgtacaactggcggagttttaccgatcgcataaatactgtggttactgcgggcatgaaatgtatccgagcaaaaccgaatgggcgatgctgtgcagccattgccgtgagcgttactacccgcaaatcgccccctgcattattgttgccatccgtcgcgatgattcgatcctcctcgcccagcatacccgccatcgtaacggtgtccatacagtacttgccggattcgtcgaagtgggcgaaaccctcgagcaggcagtcgcgcgggaagtgatggaagagagcggaattaaagttaaaaacttgcgttacgtgacttctcagccgtggccgtttcctcagtctttaatgaccgcgtttatggcggaatatgacagcggcgacatcgtgatcgacccgaaagaattgctcgaggcgaactggtatcgctatgacgatttgccgttactcccgccgcccggcaccgtagcgcgccgtctgatagaagatacggtggcgatgtgtcgggcagagtatgagtgatgatacactgaccgcctgacgcactaaggaacagccaaaatgaccgaacttaaaaacgatcgttatctgcgggcgctgctgcgccagcccgttgatgtcactccagtatggatgatgcgccaggcgggtcgctatctaccggaatataaagccacgcgcgcccaggcaggcgattttatgtcgctgtgcaaaaacgccgagctggcgtgcgaagtgactttgcaaccgctgcgtcgctacccgctggatgcggcgatcctcttttccgatatcctcaccgtgccggacgcgatggggttagggctctattttgaagccggagaaggtccgcgttttacctcgccagtcacctgcaaagctgacgtcgataaactgccaattccggacccggaagatgaactgggttacgtgatgaacgcggtgcgtaccattcgtcgcgaactgaaaggcgaagtgccgctgattggtttttccggcagcccgtggacgctggcgacctacatggtggaaggcggcagcagcaaagccttcaccgtgatcaaaaaaatgatgtatgccgatccgcaggcgctgcacgctctgctcgataaactggcgaaaagcgtcactttgtatctgaatgcgcagattaaagccggtgctcaggcagtgatgattttcgacacctggggcggcgtgcttaccgggcgcgattatcaacagttctcgctctattacatgcataaaattgttgatggtttactgcgtgaaaacgacggtcgccgcgtaccggtcacgctgtttaccaaaggcggcggacagtggctggaagccatggcagaaaccggttgcgatgcgctgggcctcgactggacaacggacatcgccgatgcgcgccgccgtgtgggcaataaagtcgcgttgcagggtaatatggatccgtcgatgctgtacgcgccgcctgcccgcattgaagaagaagtagcgactatacttgcaggtttcggtcacggcgaaggtcatgtctttaaccttggtcacggcattcatcaggatgtgccgccagaacatgctggcgtgttcgtggaggcagtgcatcgactgtctgaacagtatcaccgctaaggagtgattatggatctcgcgtcattacgcgctcaacaaatcgaactggcttcttctgtgatccgcgaggatcgactcgataaagatccaccggatctgatcgccggagccgatgtcgggtttgagcagggcggagaagtgacgcgagcggcgatggtgctgctgaaatatccctcgcttgagctggtcgagtataaagttgcccgcatcgccaccaccatgccttacattccaggttttctttccttccgcgaatatcctgcgctgctggcagcgtgggagatgctgtcgcaaaagccggatttagtgtttgtcgatggtcatgggatctcgcatcctcgccgtcttggcgtcgccagccattttggcttattggtggatgtgccgaccattggcgtggcgaaaaaacggctctgcggtaaattcgaaccgctctccagcgaaccgggcgcgctggccccactgatggataaaggcgagcagctggcctgggtctggcgcagcaaagcgcgctgtaacccgttgtttatcgctaccggccatcgggtcagcgtggacagcgcgctggcgtgggtacaacgctgcatgaaaggctatcgtctgccggagccaacgcgctgggcggacgcggtggcctcggaacgtccggcgttcgtgcgctatacagcaaatcagccctaattcaggtaaactgcggataatttccgtatttgagaactcaacatgttacaaaacccaattcatctgcgtctggagcgcctggaaagctggcagcatgtcactttcatggcttgcttatgcgaacgcatgtaccccaattacgccatgttctgccagcaaaccggttttggtgatgggcaaatttaccgtcgcattctcgatctcatctgggaaacgctgaccgttaaagacgcaaaagtaaatttcgacagccaactggagaaatttgaagaagcgattccttcagccgacgatttcgatctgtacggcgtttatccggcaatcgatgcctgcgtggcgttaagtgaactggtccattcgcgtttgagtggtgaaacgctcgaacacgcggtggaagtgagtaagacctccatcacgaccgttgcgatgctggaaatgactcaggctggtcgcgaaatgagcgatgaagagcttaaagaaaacccagctgtagagcaagaatgggacattcagtgggaaatattccgacttttagctgagtgcgaagaacgcgatatcgagctgataaaaggccttagggcagacctgcgtgaggcgggtgagagcaatattggtataatttttcagcaataagaccagaaaacgtgatttaacgcctgatttgtcgtacctggagtcttccctttcgccccccgtctggtctacatttggggggcgaaaaaaagtggctatcggtgcgtgtatgcaggagagtgctattctggcatttccgtcgcactcgatgcttagcaagcgataaacacattgtaaggataacttatgaacaagactcaactgattgatgtaattgcagagaaagcagaactgtccaaaacccaggctaaagctgctctggagtccactctggctgcaattactgagtctctgaaagaaggcgatgctgtacaactggttggtttcggtaccttcaaagtgaaccaccgcgctgagcgtactggccgcaacccgcagaccggtaaagaaatcaaaattgccgcagctaacgtaccggcatttgtttctggcaaggcactgaaagacgcagttaagtaagattgcgtggcagtgaacagttttaacgaaggggtggtttcaccccttttgtctttctggcgtcgatcattgatgctggctggcgctctgcttctcactgcctgtagtcataactcttcacttcctccctttaccgccagtggatttgctgaagaccagggcgcggtacgcatctggcgaaaagacagcggcgataatgtgcatctgcttgccgtgtttagcccgtggcgcagtggcgataccacgacgcgagagtatcgctggcagggcgataacctcacgctcatcaatatcaatgtttacagcaaaccgccggtgaatattcgcgcgcgttttgacgatcgcggtgatctgagctttatgcaacgtgaatccgatggggaaaagcagcagctttctaacgaccaaatcgatttataccgttatcgtgctgatcagatccgccagattagcgatgccttacgtcaggggagagtcgtgctgcgccaggggcgctggcatgcgatggaacagaccgtgaccacctgcgaagggcaaaccattaaacctgatttagattcgcaggcgatagcgcatatcgagcgccgccagagccgctcttctgttgatgtcagcgtggcatggctggaagcgcccgaaggttcgcaattactgttagtggcaaactctgatttctgtcgctggcaacccaacgagaaaacgttctgatttaccagtggcccatacccatatgaccgccaccaccgcagccgccgtagcccatgcccattccggctccgcgcggaatacccgcttcagccatcgcgatatctcgtttcacccgtaactcatctaacgactgacgcaaattctccatctctttggcgaccgcgttaattttgctgctatccggtgggttcgcggctaacagggcattgtattcataacgcttcgtcaccagttgctgttgcagtgcgctgctttgagcgtaaaagtcattatggattttctgccacgctgtctgttgttcgctggtcaaaggcgcggcattttgctgccacataccgtgtccgccgtgagcaaatgcagatgtcgatcccatcgccattgctgaaagcgccatcattaccagggcaattttcgtgttccgtttcatggttaatcctccagtggttgtcttacttcgggtattgcatcttccgtgccaacgatgaaacgctgatatgacgggtaatctggcatgataaacgagtaaaaatgactcgcctgctgcgggtagcgagtcatttttactcattgaaacttaagcctttgtgttacagcgcagggtaagcgctgataaaagatggcatgatttctgctgtcagaaagggatgagcaggcaaagaagaagatgcgttttatgcaacgttctaaagactccttagctaaatggttaagcgcgatcctccccgtggtcattgttgggctggtgggattgtttgcggtaactgtgattcgtgattatgggcgggcaagcgaggcagaccgccaggcattactggaaaaaggtaatgtgcttatccgcgctctggagtcgggaagccgcgtagggatggggatgcgaatgcaccatgtacagcaacaggcgcttctggaagagatggcgggacagccgggagtgttgtggttcgcagtcaccgatgcgcagggcatcattattcttcatagcgaccccgataaggtcgggcgtgcgctctattcgccggatgaaatgcagaaattaaagccagaggaaaactcccgctggcggctgcttgggaaaacggaaactacgcctgcacttgaggtctatcgtttgttccagccaatgtcagcgccctggcggcatggaatgcacaatatgccgcgctgtaacggcaaagctgtgccacaagtagatgcacaacaggctatttttatcgccgttgatgccagtgatctggttgcaacccagagtggggaaaagcgcaataccctgattatcctcttcgccctggcgacggtcttgctggcaagcgtattgtcattcttctggtatcgccgctatctgcgctcgcgccagcttctacaagatgaaatgaagcgcaaagagaagctggtggcgctggggcatcttgcggcaggcgttgcccacgaaatccgtaacccactttcctcgattaaaggactggcgaaatactttgccgagcgcgcgcctgcagggggagaagcgcatcaactggcgcaggtgatggcgaaagaggccgaccgtttaaaccgcgtggtaagcgagttgctggaactggttaagccaacgcatctggctttgcaggcggtggatctcaacacgctgattaaccactcattacagctggtaagtcaggatgcaaacagccgggagatccagttacgctttaccgccaacgacacattaccggaaattcaggccgacccggacaggctgactcaggtcctgttgaatctctatctcaatgctattcaggcgattggtcagcatggcgtgattagcgtgacggccagcgaaagcggcgcgggcgtgaaaatcagcgttaccgacagcggtaagggaattgcggcagatcagcttgatgccatcttcactccgtacttcaccactaaagccgaaggcaccggattggggctggcggtcgtgcataatattgttgaacaacacggtggtacaattcaggtcgcaagccaggagggaaaaggctcaacgttcaccctctggcttccggtcaatattacgcgtaaggacccacaaggatgacgcacgataatatcgatattctggtggtggatgatgacattagccactgcactattttgcaggctttactgcgcggctggggctataacgtcgcgctggcgaacagcgggcgacaggcgttggagcaggtgcgggaacaggtttttgatcttgtgctttgcgatgtgcgaatggcggagatggacggcatcgccacgctgaaagagatcaaagcgttaaacccggcaattccggtgctgattatgactgcgtactccagcgtcgagacggcggtagaggcactgaaaactggggcgctggattatctcatcaagccgctggatttcgataacctacaggcgacgctggaaaaagcgctcgcgcatacgcacagtattgatgctgaaacacctgcggtgactgccagccagttcggtatggtcggtaaaagcccggcgatgcaacacctgctcagtgaaatcgccctcgtcgcgccatcggaagccacggtactgatccacggcgattccggcaccggtaaagagctggtcgccagggcgattcacgccagtagcgcacgtagcgaaaaaccgctggtaacgctcaactgtgcggcactcaacgaatccttgctggaatctgaattgttcggtcacgaaaaaggggcgtttactggagccgataaacgccgggaagggcgctttgttgaggcggacggcggcacgctgtttctcgatgaaattggcgatatctcgccgatgatgcaggtgcgtctgctgcgtgcgattcaggagcgcgaagttcagcgtgtcggtagcaaccagattatctcggttgatgtccggctgattgcggcgacccatcgcgatcttgccgcagaggtgaatgccgggcgttttcgccaggatctctactatcgcctgaatgtggtggcgattgaagtaccatcgctgcggcaacggcgggaagatatccctctgctggctggccattttctgcagcgctttgccgagcgtaatcgcaaggcggtaaaaggttttacgccccaggcgatggatctgttgattcattacgactggccgggaaatattcgtgagctggaaaacgcggtggaacgggcagtggtgctgctgaccggggaatatatttccgaacgcgagctgccgctggcgattgccagtacgccgatcccgctgggacaaagtcaggatattcagccgttggtggaagtggaaaaagaggtgattctggcggcgctggagaaaacgggcggcaacaaaaccgaagccgcccgtcagttagggatcacgcgcaaaacgctattggcaaaactgtcgcgttagttctgctcgcgttcgatagcgcgccagccgatatctttccggcagaagcagtcgtcccagtggatatcggtcattaaggcataggcgcgtttctgcgcttctgccacggtatgacccagcgcggtgacgcacagtacgcgcccgccgttggtcactacctgctcgtcatccgccagttttgtgcccgcgtggaacactttgccgcctgccacttcttccagcggcaggccgtggatcacgtcaccggtgcggtaatcacccggatatccacccgcagccatcaccacgccgagagaagcgcgttcatcccactcggacgttttctcgtccagtttgctttcacaggccgccaggcagagctcaaccagatcggacttcatgcgcagcataatcggctgggtttccggatcgccaaagcggcagttaaattcaataaccttcggattgccctgtttgtcgatcatcaggcccgcgtagagaaaaccggtgtaggtgttgccttccgccgccatgcctttcacggttggccagataatacgttccatggtgcgctgatgaacgtcatcggttactaccggcgcgggggagtaagcgcccatcccgccggtgtttggtccggtatctttatcgcctacgcgtttgtgatcctggctggtagccatcggcagcacatgctcgccgtccaccatcacgataaagctcgcttcttcgccatcgaggaactcttcgataacgatgcgatgacccgcgtcgccaaaagcgttgcccgccagcatatcgtgaacagccgcttccgcttcttccagcgtcatcgccacgataacgcctttcccggcagccagaccgtccgctttaatgacgattggcgcgcctttctcacgcagatacgccagcgcaggttctacctcggtgaagttctggtattccgccgtagggatcttatggcgggccaggaaatctttggtaaacgcttttgagccttccagttgggccgcacctgcggttgggccgaagattttcagcccggcggcgcggaaggtatcgaccacgcctttcaccagcggcgcttccgggccgacgatggtcagatcaatcttttcgttttgtgcgaaatccaacagcgccgggatatcggtcacgccaatagcaacgttttgcagcgcgggttccagtgcagtgcctgcattacccggagcaacaaaaacagtctcaaccagcggcgactgggccgctttccaggccagcgcgtgctcgcgcccgccgttaccaatcactaatactttcatctattgctccattaatggcggaagtggcgcatgtcggtgaagagcatcgcaataccgtgctcgtcggcggcggcaatcacttcgtcatcacggatagaaccgccaggctggattacgcaggtcacgcccgcagcggcggcggcatcaataccgtcgcggaacgggaagaacgcgtcagaagccatcgaggaacctttcacttccaggccttcatcggccgctttaataccggcgatttttgcggagtacacgcggctcatctggcccgcgccaatgccgatagtcatattgtttttggcatagacgatagcgttggatttcacaaacttcgccaccttccagcagaacagcgcatcacgcagttcctgttcgctcggctgacgtttggtcaccacgcgcagttcttccgcaccgaccatccccaggtcacgatcctgaaccagcagaccgccgttcacgcgtttgaaatcgaggcccggaacacgctcgccccactgaccgcaggtcagaacgcgtacgttctgtttggcggcggtgattttcagggcttcttcgctggcggacggcgcaataatcacttcgacaaactgacgagaaatgatggcctgtgcggtttccgcatccagctcgcggttaaaggcaatgatgccgccgaatgcggaggttgggtcggttttgtacgcgcgatcgtaagcatcaagaatggaattgccgatagccacgccgcaagggttggcgtgcttcacaatcacacatgccggctcggcgaactctttcacgcactccagcgccgcatcggtatcggcgatgttgttataagagagggctttaccctgaacctgggttgcggtagcaacggaggcttctttcacattctcttctatatagaaggcagcctgctggtggctgttctcgccgtaacgcatatccagcttcttaatgaagttcaggttcagcgtgcgtgggaagcgaccggcggcttctttgctttcaccgtggtaagccggaaccatgctgccgaagtagttggcaatcatgctgtcgtaggcggcagtgtgttcgaaggctttgatggcgaggtcgaaacgggttgcaagcgtcagcgatccttcgttgtcatccatctctttaataatggcgtcatagtcgctgctcttcaccacgattgcgacatctttatggttcttggcggcggagcgcaccatcgttgggccgccgatatcgatgttctcaaccgcatcttccagcgagcaaccttcacgggccacggtctgggcgaacggatacaggttaacaaccaccatatcgataggctggatctgatgttcttccataatggcatcgtcctggccgcgacggcccagaatgccaccatgtactttcggatgcagggtcttcacgcgtccatccatcatctccgggaaaccggtgtaatcggaaacttcggttaccggcagacctttttctgctaacagacgggcagtgccccctgtagacagcagctccacaccgcgtgcggaaagtgcctgggcgaattcgacgataccggctttgtcagaaacactgagcagagcgcggcggactggacgacgttgttgcatggtaaatcccctggatttgactattacagagagcgttagctgaatttttcgcgaaaaactcagctaacgcccctaacggggcatccttatttttcgcccgcattgtaacgaaaacgtttgcgcaacgctcgcgaatttttctctttcaatggtgatcacaattttgactgtggttaccgtgggcaaaatacagaaattacattgatgattgtggataactctgtgcgtaaaaaggtataaagcgggcttttgctggggaatgcagcagtcagtcatttttctgcaatttttctattgcggcctgcggagaactccctataatgcgcctccatcgacacggcggatgtgaatcacttcacacaaacagccggttcggttgaagagaaaaatcctgaaattcagggttgactctgaaagaggaaagcgtaatatacgccacctcgcgacagtgcgctaaagcgcgtcgcaactgctctttaacaatttatcagacaatctgtgtgggcactcgaagatacggattcttaacgtcgcaagacgaaaaatgaataccaagtctcaagagtgaacacgtaattcattacgaagtttaattctttgagcatcaaacttttaaattgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgcagtgctcacacagattgtctgatagaaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgaaagttgttcgtgagtctctcaaattttcgcaacacgatgatgaatcgtaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgcgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaggtccctcgcggatggagctgaaatcagtcgaagataccagctggctgcaactgtttattaaaaacacagcactgtgcaaacacgaaagtggacgtatacggtgtgacgcctgcccggtgccggaaggttaattgatggggttagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaaggtgttttggcggattgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaattagaaaaaccccggtccataaggccggggttttttgcatatcaattatttgcatgatgaagggaatctcatgtcagttctgtatatccaaattcgtcgtaatcaaattactgttcgcgatcttgaaagcaaacgtgaagtgtcaggagacgctgccttcagtaaccagcgcctgttaatcgccaatttctttgttgcagaaaaagttctgcaagatcttgttctgcaactccacccacgttcaacctggcattcttttttgccagcaaaacgtatggatattgttgtgagcgcactggaaatgaatgagggcggtttgtcacaggttgaggaacgcattctccatgaagtggtcgctggggcaacgttaatgaaatatcgccagttccacatccatgcgcaatcagcggtactcagtgatagtgcggtcatggcaatgcttaagcagaaataatcgtgtcaccattggtgggtactaaacctgaagttcagcccaccgggatgagaaaaaatcgcctacgcccccacatacgccagattcagcaacggatacggtttccccaaatcgtccacctcagagcgtcccgtaaccttaaaacccaccttcttatagaacccaaccgcctgctcattttgctcattaacgttggttgtcagttccggtgccatcgagagcgcatgctccaccagcacccgacctacgccgcagccgcgcacatcaggatcgataaacagcgcatccatatgctgcccacttagcaacataaatccaaccggctgatcccgctcattaaccgcgacccacaacggcgcttccggcaggaaggaacgaactaggtcctccagctcggtccgatactctgctgatagaaaatcgtgagtggcatcgacagaacgacaccaaatcgcaacgagttcctccccttcctcatgccgtgagcggcgaatactaataaccattttctctccttttagtcattcttatattctaacgtagtcttttccttgaaactttctcaccttcaacatgcaggctcgacattggcaaattttctggttatcttcagctatctggatgtctaaacgtataagcgtatgtagtgaggtaatcaggttatgccgattcgtgtgccggacgagctacccgccgtcaatttcttgcgtgaagaaaacgtctttgtgatgacaacttctcgtgcgtctggtcaggaaattcgtccacttaaggttctgatccttaacctgatgccgaagaagattgaaactgaaaatcagtttctgcgcctgctttcaaactcacctttgcaggtcgatattcagctgttgcgcatcgattcccgtgaatcgcgcaacacgcccgcagagcatctgaacaacttctactgtaactttgaagatattcaggatcagaactttgacggtttgattgtaactggtgcgccgctgggcctggtggagtttaatgatgtcgcttactggccgcagatcaaacaggtgctggagtggtcgaaagatcacgtcacctcgacgctgtttgtctgctgggcggtacaggccgcgctcaatatcctctacggcattcctaagcaaactcgcaccgaaaaactctctggcgtttacgagcatcatattctccatcctcatgcgcttctgacgcgtggctttgatgattcattcctggcaccgcattcgcgctatgctgactttccggcagcgttgattcgtgattacaccgatctggaaattctggcagagacggaagaaggggatgcatatctgtttgccagtaaagataagcgcattgcctttgtgacgggccatcccgaatatgatgcgcaaacgctggcgcaggaatttttccgcgatgtggaagccggactagacccggatgtaccgtataactatttcccgcacaatgatccgcaaaatacaccgcgagcgagctggcgtagtcacggtaatttactgtttaccaactggctcaactattacgtctaccagatcacgccatacgatctacggcacatgaatccaacgctggattaatcttctgtgatagtcgatcgttaagcgattcagcaccttacctcaggcaccttcgggtgccttttttatttccgaaacgtacctcagcaggtgaataaattttattcatattgttatcaacaagttatcaagtatttttaattaaaatggaaattgtttttgattttgcattttaaatgagtagtcttagttgtgctgaacgaaaagagcacaacgatccttcgttcacagtggggaagttttcggatccatgacgaggagctgcacgatgactgaacaggcaacaacaaccgatgaactggctttcacaaggccgtatggcgagcaggagaagcaaattcttactgccgaagcggtagaatttctgactgagctggtgacgcattttacgccacaacgcaataaacttctggcagcgcgcattcagcagcagcaagatattgataacggaacgttgcctgattttatttcggaaacagcttccattcgcgatgctgattggaaaattcgcgggattcctgcggacttagaagaccgccgcgtagagataactggcccggtagagcgcaagatggtgatcaacgcgctcaacgccaatgtgaaagtctttatggccgatttcgaagattcactggcaccagactggaacaaagtgatcgacgggcaaattaacctgcgtgatgcggttaacggcaccatcagttacaccaatgaagcaggcaaaatttaccagctcaagcccaatccagcggttttgatttgtcgggtacgcggtctgcacttgccggaaaaacatgtcacctggcgtggtgaggcaatccccggcagcctgtttgattttgcgctctatttcttccacaactatcaggcactgttggcaaagggcagtggtccctatttctatctgccgaaaacccagtcctggcaggaagcggcctggtggagcgaagtcttcagctatgcagaagatcgctttaatctgccgcgcggcaccatcaaggcgacgttgctgattgaaacgctgcccgccgtgttccagatggatgaaatccttcacgcgctgcgtgaccatattgttggtctgaactgcggtcgttgggattacatcttcagctatatcaaaacgttgaaaaactatcccgatcgcgtcctgccagacagacaggcagtgacgatggataaaccattcctgaatgcttactcacgcctgttgattaaaacctgccataaacgcggtgcttttgcgatgggcggcatggcggcgtttattccgagcaaagatgaagagcacaataaccaggtgctcaacaaagtaaaagcggataaatcgctggaagccaataacggtcacgatggcacatggatcgctcacccaggccttgcggacacggcaatggcggtattcaacgacattctcggctcccgtaaaaatcagcttgaagtgatgcgcgaacaagacgcgccgattactgccgatcagctgctggcaccttgtgatggtgaacgcaccgaagaaggtatgcgcgccaacattcgcgtggctgtgcagtacatcgaagcgtggatctctggcaacggctgtgtgccgatttatggcctgatggaagatgcggcgacggctgaaatttcccgtacctcgatctggcagtggatccatcatcaaaaaacgttgagcaatggcaaaccggtgaccaaagccttgttccgccagatgctgggcgaagagatgaaagtcattgccagcgaactgggcgaagaacgtttctcccaggggcgttttgacgatgccgcacgcttgatggaacagatcaccacttccgatgagttaattgatttcctgaccctgccaggctaccgcctgttagcgtaaaccaccacataactatggagcatctgcacatgaaaacccgtacacaacaaattgaagaattacagaaagagtggactcaaccgcgttgggaaggcattactcgcccatacagtgcggaagatgtggtgaaattacgcggttcagtcaatcctgaatgcacgctggcgcaactgggcgcagcgaaaatgtggcgtctgctgcacggtgagtcgaaaaaaggctacatcaacagcctcggcgcactgactggcggtcaggcgctgcaacaggcgaaagcgggtattgaagcagtctatctgtcgggatggcaggtagcggcggacgctaacctggcggccagcatgtatccggatcagtcgctctatccggcaaactcggtgccagctgtggtggagcggatcaacaacaccttccgtcgtgccgatcagatccaatggtccgcgggcattgagccgggcgatccgcgctatgtcgattacttcctgccgatcgttgccgatgcggaagccggttttggcggtgtcctgaatgcctttgaactgatgaaagcgatgattgaagccggtgcagcggcagttcacttcgaagatcagctggcgtcagtgaagaaatgcggtcacatgggcggcaaagttttagtgccaactcaggaagctattcagaaactggtcgcggcgcgtctggcagctgacgtgacgggcgttccaaccctgctggttgcccgtaccgatgctgatgcggcggatctgatcacctccgattgcgacccgtatgacagcgaatttattaccggcgagcgtaccagtgaaggcttcttccgtactcatgcgggcattgagcaagcgatcagccgtggcctggcgtatgcgccatatgctgacctggtctggtgtgaaacctccacgccggatctggaactggcgcgtcgctttgcacaagctatccacgcgaaatatccgggcaaactgctggcttataactgctcgccgtcgttcaactggcagaaaaacctcgacgacaaaactattgccagcttccagcagcagctgtcggatatgggctacaagttccagttcatcaccctggcaggtatccacagcatgtggttcaacatgtttgacctggcaaacgcctatgcccagggcgagggtatgaagcactacgttgagaaagtgcagcagccggaatttgccgccgcgaaagatggctataccttcgtatctcaccagcaggaagtgggtacaggttacttcgataaagtgacgactattattcagggcggcacgtcttcagtcaccgcgctgaccggctccactgaagaatcgcagttctaagcaacaacaaccgttgctgactgtaggccggataaggcgttcacgccgcatccggcaatcggtgcacgatgcctgatgcgacgcttgcgcgtcttatcatgcctacagccgttgccgaacgtaggctggataaggcgtttacgccgcatccggcaattctctgctcctgatgagggcgctaaatgccgcgtggcctggaattattgattgctcaaaccattttgcaaggcttcgatgctcagtatggtcgattcctcgaagtgacctccggtgcgcagcagcgtttcgaacaggccgactggcatgctgtccagcaggcgatgaaaaaccgtatccatctttacgatcatcacgttggtctggtcgtggagcaactgcgctgcattactaacggccaaagtacggacgcggcatttttactacgtgttaaagagcattacacccggctgttgccggattacccgcgcttcgagattgcggagagcttttttaactccgtgtactgtcggttatttgaccaccgctcgcttactcccgagcggctttttatctttagctctcagccagagcgccgctttcgtaccattccccgcccgctggcgaaagactttcaccccgatcacggctgggaatctctactgatgcgcgttatcagcgacctaccgctgcgcctgcgctggcagaataaaagccgtgacatccattacattattcgccatctgacggaaacgctggggacagacaacctcgcggaaagtcatttacaggtggcgaacgaactgttttaccgcaataaagccgcctggctggtaggcaaactgatcacaccttccggcacattgccatttttgctgccgatccaccagacggacgacggcgagttatttattgatacctgcctgacgacgaccgccgaagcgagcattgtttttggctttgcgcgttcttattttatggtttatgcgccgctgcccgcagcgctggtcgagtggctacgggaaattctgccaggtaaaaccaccgctgaattgtatatggctatcggctgccagaagcacgccaaaaccgaaagctaccgcgaatatctcgtttatctacagggctgtaatgagcagttcattgaagcgccgggtattcgtggaatggtgatgttggtgtttacgctgccgggctttgatcgggtattcaaagtcatcaaagacaggttcgcgccgcagaaagagatgtctgccgctcacgttcgtgcctgctatcaactggtgaaagagcacgatcgcgtgggccgaatggcggacacccaggagtttgaaaactttgtgctggagaagcggcatatttccccggcattaatggaattactgcttcaggaagcagcggaaaaaatcaccgatctcggcgaacaaattgtgattcgccatctttatattgagcggcggatggtgccgctcaatatctggctggaacaagtggaaggtcagcagttgcgcgacgccattgaagaatacggtaacgctattcgccagcttgccgctgctaacattttccctggcgacatgctgtttaaaaacttcggtgtcacccgtcacgggcgtgtggttttttatgattacgatgaaatttgctacatgacggaagtgaatttccgcgacatcccgccgccgcgctatccggaagacgaacttgccagcgaaccgtggtacagcgtctcgccgggcgatgttttcccggaagagtttcgccactggctatgcgccgacccgcgtattggtccgctgtttgaagagatgcacgccgacctgttccgcgctgattactggcgcgcactacaaaaccgcatacgtgaagggcatgtggaagatgtttatgcgtatcggcgcaggcaaagatttagcgtacggtatggggagatgcttttttgagtaaagcttccatataatttttctccgcaatgtatcgagggttatccgtaaagccaaagctttcagccatcttatttaatgtattaaggattaattcagcaataacccggtgaccaaattcaaaagccaactcaaaggcagagtatttttgtggggctttgtgttgccaaaaatccataatatcttcagcggtaaatccaaacaggcgtgcatggtcagataaagcaagataaaccgtctctacaacattttgttgtttatgctgtatcgctgaaaacaaaccgggatattcattagaattatttgccaggaggaggggcttcatattttttttatcgaatttaaacgtattaaacagagtgggtaatgcgttaaaaatagtattaataacgttcatgtgtccgcgctgcatggccataaacaaacccgtgtcgcgcgcaagacttttagcggtcagaagatctacaatatcggaagctgaaatgttaatttcctgggctaggctgggcaatgcttcaagaataactttcacgatatcgctatgtccattttgcatcgccagatatagtcctgggcaaccataaaaatcctttgccttcaggagatcgagtacctgttctttagtcaaatgacatgtgcgaattaacaaaggtaacgcgttcaaaacaattttcagcatgtcggcatcaccattcgccataacatggtataaaacatggctggacgttctatttttggcactcaggaatttatacacttgttcgttatctaaatgatgtgttgcggccagtttaggtaaggcgttcagaatcgaggttacaacatttttatccttacgtgatatcgctaaaaataatccagaaaaaccatttttatcttttgcctccagaatatgcatgagattttttttcgagagtaatccttcatatcctgtttctgacaatgaattgaaaatagtctcaacgatatccgcattaccataatttatagccaaatataaacctggcaggttaatactattataggcagtcaacatttctgttctatgtagttctggcattttctggagttgaatcatcagttgcgtaagttggtgattctgaccaattgccattagcaaattcatcgttgcaggtgataatggaggggttatttcatccacagatccttttaacatcaatagctgttctttcggaagtgctggaattattgcaacagattgattaataacatgatcatttgaccatttcaggaggctataatctacattcataaaatccatcagagaatagtgtttaatattctctttgctttcgctcataattcttattttatcgttagttacattaggatcataaaccgaaaccacgtaatgggtacatccttcagttgtgttctttattcttagccggaccgtcaaagcatggttatccaccagtaatatggctgccataacactgatgccatttgattccatcttgtcaaaatatgctttcataactagcccgaaatcaccgcaggcagcaacgcaacgcccctcaggacggctggaaaccaacgccaaagtctggtttttgcattttttgttgaagtgcgtgagaaatttttcagctgaagagtaatcatcttgatggggtttgtaatcaacattctgataaatatcattaatatattgtgcagcaatgtgtcggcatactatacggttttggggtcgccccggaaaataacattgaccattaagtttaattcttgggaattctttttcttttctatctgattttaggtttaattcttgtttatcaagagtgtctgagcgttgaggtaaaatttccattaggtatttttcaaatattggggcaatggtttgagtaagtgtcgtgttttcgtttttattaattatcgtaatttctttcttatcagcttgtaagacggacgtggaaaatttaatgacaaaatccttgttgctaaagatatgacgaccattttgtctacagttctctgagaagctttttaatagaggcgtcgccagctccttgccagaaaatttatcctcgagttctttataaaacaattcactcagggtttggtgttcatttgtctgggctgtattattaatatttgcagagaaagaactacgaggaatacgagtaatcatttaaatatctcattgtttattgatgtcttgaattttaactatcagaacagtgaaaaaatttaatatgattacaactaaagaaatatcataaatcgctcaatctcataatgcagccgtaaaagtttcggtggaatgagatcttgcgattttgttaataattaagtggtttgatgtttaaaaataatgctgagttaataaaagtgtgtgaagtgtatgacattaagttattttggcgtcaatgcgattaacagacacccttattctattgccactcaggtatgatgggcagaatattgcctctgcccgccagaaaaagtcagcgcattccaccgtacgccagcgtcacttccttcgccgctttaatcaccatcgcgccaaactcggtcacgcggtcatcggtaatacgtgaaatcggtccggaaatagaaattgcggcaaacggttcacggtgctcatcgaaaatacacgctgcaaggcaacgtagccccagtgcatgttcctcatcgtcaaatgaataaccccgtttgcgcgtttgggcgagatcttcttttaaatgcacaggagacaccagcgttgcgtgggtataggcatgtaaccctttgcggtgcagcagcttcgtcacctgttcttcgctcagttgggctaaaaaggctttacccgcaccggaagcgtgcatcggcaatttaccgccgataggcgcggacattcgcatcagatgcgtacactgtacctggtcgataataatcgcttcgtgatcgctttgatcaagcaccgccatattgaccgtttcgccagactcttccattagattgcgcaggatagggtgaacaatcgctaacaaattacggctctggagaaagctgctgccgaccataaaggcatgtgcgccgattgcccaatgtcccagttcgccaacctgacgcacgaaaccctgctgttgcatcgtggttagcaggcggtgggtcgtggaattgggtaacccggcttgttgcgccagttccgtgagtgccacactgccattggattcggcaatccactccagtaatttcaggccacgcgttaaagactgaacctgtccagtcgctggtgcggtggcaacggcgggttttctgccgcgtttcgcgggaatgggtgcgaccatgacagtctcttttttctgtatcgtggaaatcattttcatttttattgttagctaatgcaatagttactgaactgatccgatgagttaatgttgaacaaatctcatgttgcgtggtggtcgcttttaccacagatgcgtttatgccagtatggtttgttgaatttttattaaatctgggttgagcgtgtcgggagcaagtgtgagcagcaaagtggaacaactgcgtgcgcagttaaatgaacgtattctggtgctggacggcggtatgggcaccatgatccagagttatcgactgaacgaagccgattttcgtggtgaacgctttgccgactggccatgcgacctcaaaggcaacaacgacctgctggtactcagtaaaccggaagtgatcgccgctatccacaacgcctactttgaagcgggcgcggatatcatcgaaaccaacaccttcaactccacgaccattgcgatggcggattaccagatggaatccctgtcggcggaaatcaactttgcggcggcgaaactggcgcgagcttgtgctgacgagtggaccgcgcgcacgccagagaaaccgcgctacgttgccggtgttctcggcccgaccaaccgcacggcgtctatttctccggacgtcaacgatccggcatttcgtaatatcacttttgacgggctggtggcggcttatcgagagtccaccaaagcgctggtggaaggtggcgcggatctgatcctgattgaaaccgttttcgacacccttaacgccaaagcggcggtatttgcggtgaaaacggagtttgaagcgctgggcgttgagctgccgattatgatctccggcaccatcaccgacgcctccgggcgcacgctctccgggcagaccaccgaagcattttacaactcattgcgccacgccgaagctctgacctttggcctgaactgtgcgctggggcccgatgaactgcgccagtacgtgcaggagctgtcacggattgcggaatgctacgtcaccgcgcacccgaacgccgggctacccaacgcctttggtgagtacgatctcgacgccgacacgatggcaaaacagatacgtgaatgggcgcaagcgggttttctcaatatcgtcggcggctgctgtggcaccacgccacaacatattgcagcgatgagtcgtgcagtagaaggattagcgccgcgcaaactgccggaaattcccgtagcctgccgtttgtccggcctggagccgctgaacattggcgaagatagcctgtttgtgaacgtgggtgaacgcaccaacgtcaccggttccgctaagttcaagcgcctgatcaaagaagagaaatacagcgaggcgctggatgtcgcgcgtcaacaggtggaaaacggcgcgcagattatcgatatcaacatggatgaagggatgctcgatgccgaagcggcgatggtgcgttttctcaatctgattgccggtgaaccggatatcgctcgcgtgccgattatgatcgactcctcaaaatgggacgtcattgaaaaaggtctgaagtgtatccagggcaaaggcattgttaactctatctcgatgaaagagggcgtcgatgcctttatccatcacgcgaaattgttgcgtcgctacggtgcggcagtggtggtaatggcctttgacgaacagggacaggccgatactcgcgcacggaaaatcgagatttgccgtcgggcgtacaaaatcctcaccgaagaggttggcttcccgccagaagatatcatcttcgacccaaacatcttcgcggtcgcaactggcattgaagagcacaacaactacgcgcaggactttatcggcgcgtgtgaagacatcaaacgcgaactgccgcacgcgctgatttccggcggcgtatctaacgtttctttctcgttccgtggcaacgatccggtgcgcgaagccattcacgcagtgttcctctactacgctattcgcaatggcatggatatggggatcgtcaacgccgggcaactggcgatttacgacgacctacccgctgaactgcgcgacgcggtggaagatgtgattcttaatcgtcgcgacgatggcaccgagcgtttactggagcttgccgagaaatatcgcggcagcaaaaccgacgacaccgccaacgcccagcaggcggagtggcgctcgtgggaagtgaataaacgtctggaatactcgctggtcaaaggcattaccgagtttatcgagcaggataccgaagaagcccgccagcaggctacgcgcccgattgaagtgattgaaggcccgttgatggacggcatgaatgtggtcggcgacctgtttggcgaagggaaaatgttcctgccacaggtggtcaaatcggcgcgcgtcatgaaacaggcggtggcctacctcgaaccgtttattgaagccagcaaagagcagggcaaaaccaacggcaagatggtgatcgccaccgtgaagggcgacgtccacgacatcggtaaaaatatcgttggtgtggtgctgcaatgtaacaactacgaaattgtcgatctcggcgttatggtgcctgcggaaaaaattctccgtaccgctaaagaagtgaatgctgatctgattggcctttcggggcttatcacgccgtcgctggacgagatggttaacgtggcgaaagagatggagcgtcagggcttcactattccgttactgattggcggcgcgacgacctcaaaagcgcacacggcggtgaaaatcgagcagaactacagcggcccgacggtgtatgtgcagaatgcctcgcgtaccgttggtgtggtggcggcgctgctttccgatacccagcgtgatgattttgtcgctcgtacccgcaaggagtacgaaaccgtacgtattcagcacgggcgcaagaaaccgcgcacaccaccggtcacgctggaagcggcgcgcgataacgatttcgcttttgactggcaggcttacacgccgccggtggcgcaccgtctcggcgtgcaggaagtcgaagccagcatcgaaacgctgcgtaattacatcgactggacaccgttctttatgacctggtcgctggccgggaagtatccgcgcattctggaagatgaagtggtgggcgttgaggcgcagcggctgtttaaagacgccaacgacatgctggataaattaagcgccgagaaaacgctgaatccgcgtggcgtggtgggcctgttcccggcaaaccgtgtgggcgatgacattgaaatctaccgtgacgaaacgcgtacccatgtgatcaacgtcagccaccatctgcgtcaacagaccgaaaaaacaggcttcgctaactactgtctcgctgacttcgttgcgccgaagctttctggtaaagcagattacatcggcgcatttgccgtgactggcgggctggaagaggacgcactggctgatgcctttgaagcgcagcacgatgattacaacaaaatcatggtgaaagcgcttgccgaccgtttagccgaagcctttgcggagtatctccatgagcgtgtgcgtaaagtctactggggctatgcgccgaacgagaacctcagcaacgaagagctgatccgcgaaaactaccagggcatccgtccggcaccgggctatccggcctgcccggaacatacggaaaaagccaccatctgggagctgctggaagtggaaaaacacactggcatgaaactcacagaatctttcgccatgtggcccggtgcatcggtttcgggttggtacttcagccacccggacagcaagtactacgctgtagcacaaattcagcgcgatcaggttgaagattatgcccgccgtaaaggtatgagcgttaccgaagttgagcgctggctggcaccgaatctggggtatgacgcggactgattcacaaatctgtcacttttccttacaacaaacagggcgctcaatgagtgccctgtctctttattaatatgaaacacttatactggaaacaggctggaataatcttagccggaaaaacgaatgtcaaaaggcacagtaaagatgccagtcagcgtgtttccggtcctttggtcattcaattgcttcaggaacatataacgataaggagaacctgaactcgtgttaacgctgcttcacctgctttctgccgtcgccctgctggtctgggggactcatattgttcgaaccggcgtaatgcgcgtcttcggcgcgcgtttgcgtactgtccttagccggagcgtcgaaaaaaagccgctcgccttttgcgcggggatcggcgttaccgcactggtacagagcagtaatgccaccaccatgctggtgacctcgtttgtcgctcaggatctggtagccctcgcaccggctctggtcattgtgctgggtgcagatgtcgggacggcgctaatggcgcgtattctcaccttcgacttatcctggctgtcaccgttacttatttttatcggcgtgatttttttcctcggacgcaaacagtcacgcgccgggcaactgggccgcgtcggtattggtcttgggctgattttgctagcgctggagttgattgtgcaggccgtaacgccgatcacccaggcaaacggcgttcaggtgatctttgcctcgctgaccggcgatattctgctggatgcgctgattggcgcgatgttcgccattatcagctactccagccttgctgctgtactgctgaccgcgactctgaccgccgcaggcattatctccttccccgtggcgctctgtctggtgattggtgctaacctcggttccggtctgctggcaatgctcaacaacagtgccgccaatgccgcagcccgccgtgtcgcgctgggtagtctgctgtttaagctggtgggtagcctgattatcctgccgtttgtccatttgctggcagagacaatggggaagttgtcattgccaaaagcggaactggtgatctatttccacgtcttctacaaccttgtacgttgcctggtcatgctgccatttgttgacccgatggcacggttttgcaaaacgattattcgcgatgaaccggaactggatacccagctacggcctaaacatctggatgtcagcgcgctggatacgcccacgcttgctctggcgaacgccgcgcgcgaaaccctgcgcattggcgacgccatggaacagatgatggaagggttgaataaagtgatgcacggtgagccacggcaggagaaagagctgcgtaagctggcagatgatatcaacgttctctacaccgccattaagctgtatctggcgcggatgccaaaagaagagctggcggaggaagagtcgcgccgctgggcagagatcatcgaaatgtcgctcaaccttgaacaggcctccgatatcgtcgagcgcatgggcagcgaaattgctgacaaatcactggcagcacggcgggcattttcgcttgatgggttgaaggaactggatgcgctctatgagcaattgctcagtaatttaaagctggcaatgtcggtgttcttctctggcgatgtcaccagcgctcgtcgtttgcgtcgcagcaaacatcgttttcgcattcttaatcgccgctattcccacgcccacgtcgatcgcctgcatcagcaaaacgtgcagagcattgaaaccagttcgctacatttaggcttactgggagatatgcagcgcctgaactcgctgttttgttcggtggcttacagtgtgctggaacagccggatgaagatgaaggacgggacgagtattaatattgtgaatcctgtaggcctgataagacgcgtcaagcgtcgcatcaggcactatgaacaagatgccggatcatgcatccggcaattcacttaaaaacggtgaccagcttccagcggaaccgcttcttcaccagccttaaacacataagtggtgttcgggccacccagcgtagcgtgacctttactcactgtgatccagttaccttccggtagaccaataatcgtcagttctggcgcgacgaccagcagttcgcgaatacgctgctcacgggtttcacctttatggccttccggcagcgcgttggtgaagtgcgggttgatttgcagcgggaacagatttagcgcatcgaaaccttgcggatcgacaatcggcatatcgttggtggtacgaatagttgggcaagcaaggttagcgcctgcgctccagccaatatacagagcgccacgtttaaccacgtcagtaattggtgccagcagcccgcgctcgcggcactgtttcagcaactggaaagtattcccgccgccgacaatcacgatctcagcattttcaatcgcggcaacgggatcgacaacgctatgaataccggtgacagaaacacccagcggagcgagaaccgcagccgttttcgctgtgtaatcatcccaggtctgcgttacgccagcgaaagggataaacaccgctgagcggcgaccctgcaactgttcagcaattagcggcagtgcatgttccagccaggctttacccggcagcgtcgagttactcaataaaagcagttccattacttctccggttagtaagaaatcacgggaggcatgctaccactgcgaatttaaccacttactgacatggctcacgatgtcgcacattgcttctggaaagtgatttgagcaggtaacgaattcaagccaatggaaataacaaatagttcgctcatgactattttttatcaacccaaaggtacggtatattccgttttttacaggagaatttatgctgcccgactcatcagtccgtttaaataaatacatcagcgaaagcggaatttgctcacgccgcgaagcggatcgctatatcgagcaaggcaatgtgttccttaatggcaagcgagccaccattggcgatcaggtgaaacccggcgacgttgtgaaagtaaacggtcagttgattgaacctcgggaagccgaagatttggtacttatcgccctgaacaagcccgttggtattgtaagcaccaccgaagatggcgagcgcgataacattgtcgatttcgttaaccacagcaaacgcgtgttcccgattggccgcctggataaagactcccaggggctgattttcctcaccaatcacggcgatctggtgaataagatcctgcgtgctggcaatgatcatgagaaagagtatctggtgacggtcgataaaccgattaccgaggagtttattcgcggcatgagtgcgggggtgccaatcctcgggacagtgaccaaaaagtgcaaagttaaaaaagaagcgccgtttgtcttccgcattaccctggtgcaggggctgaaccgtcagatccggcgcatgtgcgagcatttcggctatgaagtgaaaaagctggaacgcacgcgcatcatgaacgttagcttaagcggcattccgctgggggaatggcgcgatttaaccgacgatgagttaatcgacctctttaagctcattgaaaattcctcttccgaggtaaaacctaaagcgaaggccaaaccgaaaacagcgggcatcaaacgtccagtcgttaagatggaaaaaacggcggaaaaaggcggtcgcccggcgtccaacggtaagcgttttacctcgccggggcgtaaaaagaaggggcgctgattaacgcctcagactgatgaaaacggcccaaaagtgcccggacagtcccctcgccccttcgggaaaagggttagggtgaggggaaaattgtgttcacactgacgagtgaaaatctcaggcgttgattgtggattagcgcctgccgcgcgtcgacgtatttgctgaccagctaaatgacgcttcaggatccggtttataagcctgctttttcttcaactggcgggcttttttcgcttcagcctcacgctcaaccattaatttatcgatgtaatctttcttaatgctgttggtttcggagttggtcaatacgcgaccatgcgcaatccgcgcccgatccagcagtgttttaagttcacgctgctcgcgttcagtcatctctttttgggtaatacgggggagtgccatgatggtgccctcagtgagccagagagttcagtgtacgggaattcgtttgcgagcagaactgataatattcattttgccttctcttaactatttatctctttcgataattaattagagatgcagataaaaaaattaaaggcaattattctccgataaagacgctggttaacagagtacaggctcgtttattgatgagcatagtgacaagaaaatcaatacggcccgaaatatagcttccaggccatacagtatttactcaaacaaattactatgcagtttttgcaccacctgctcggcatcttcgccgggcaccaggaagcacaggttatggctggatgcgccataacaaatcatgcgaatgttgaacggttccagtacgccgaatacctctttgccaacgccgcaggcttttgacaggtcattgccaatcaacgcgaccagcgccagaccttcttccacctccacccgacacagtgcggaaagctccatcagcagagattgcgtcagcaacgtatcgccagtggaggttgaaccggtggtatcaagggttaatgccacgctcacttctgacgtggtgattaagtctaccgaaatattatgccgcgcgaggatgccgaaaacttccgcgaggaaaccgcgagaatgcagcatattcaggctgtgcaaagtgagcagagtctgattgcgacgaagcgccagagcgcggaacagcggcggattttcagttttattgcacaccagcgtaccacctgcgcgtgggtctttgctggagccgacaaagaccgggatatcgctgcgtactgcgggtagcaacgttgccggatgcagtacttttgcaccaaaagttgccatctctgccgcttcggcaaacgcgatttcatcaatgcgttttgctgcggaaactacgcgtggatcggtggtgtagatgcccgggacgtcggtccagatatcaacacgagatgcgtgtaaagcctccgccagcaaggctgccgtataatcgctgcctccacggccaagcgtcgttgtacgacctttattttcgctaccgataaatccctgggtgatcactaagccttcattgagacgtgggagcagctgcagcgcggccagttccgccagcgcggctatatctggctctgcacgaccaaatcggtcgttggtacgcatcactttacgtacatcaaaccactgtgcctgaacatcgcgttcgcgcaggatctcaacaaacagcagggtcgacatcagctcgccgtggctgaccagctcatctgtcagcgccggagacgttgccagcgccgccgcttctgccagaacagtaatgttctccagcagacgttcaatctcttcacggataacgttcgggtaacgcagacgttccagaatggcaaactggatgttgcggatagcgtcgagtttttcgaatcgctcgccaggttccagtccttcagctaaagcgaccagcagattagtgataccagcagaagccgagaggacaactaaacgcacgttggcatcagaaagcacaatatcagcgctgcggttcatggcgtcaaaatcagctacgctggtaccgccaaatttggagacaacaatttcagacataactacctcgtgtcaggggatccattttcagccttggcacaagggaagagcggaagacgggtgggcgcagagcgatacttcgctactattttcacccagaagtgctccaccacttgcgaaacgcccgactgcgaacgcttctggtgacaacccaggggattcagcccctgtagccgatgatgaacgtggccagccgttcaatcacctcggcgatgcaccccctcaggtgttatcacaggactggctcctccaacaccgttacttgggcaacgcgcctcttctggcctgcgctagcgcaggtagtacatttataaataaagggtgagcggggcggttgtcaacgatggggtcatgcggatttttcatccactcctggcggtcagtagttcagctaataaatgcttcactgcgctaagggtttacactcaacattacgctaacggcactaaaaccatcacatttttctgtgactggcgctacaatcttccaaagtcacaattctcaaaatcagaagagtattgctaatgaaaaacatcaatccaacgcagaccgctgcctggcaggcactacagaaacacttcgatgaaatgaaagacgttacgatcgccgatctttttgctaaagacggcgatcgtttttctaagttctccgcaaccttcgacgatcagatgctggtggattactccaaaaaccgcatcactgaagagacgctggcgaaattacaggatctggcgaaagagtgcgatctggcgggcgcgattaagtcgatgttctctggcgagaagatcaaccgcactgaaaaccgcgccgtgctgcacgtagcgctgcgtaaccgtagcaataccccgattttggttgatggcaaagacgtaatgccggaagtcaacgcggtgctggagaagatgaaaaccttctcagaagcgattatttccggtgagtggaaaggttataccggcaaagcaatcactgacgtagtgaacatcgggatcggcggttctgacctcggcccatacatggtgaccgaagctctgcgtccgtacaaaaaccacctgaacatgcactttgtttctaacgtcgatgggactcacatcgcggaagtgctgaaaaaagtaaacccggaaaccacgctgttcttggtagcatctaaaaccttcaccactcaggaaactatgaccaacgcccatagcgcgcgtgactggttcctgaaagcggcaggtgatgaaaaacacgttgcaaaacactttgcggcgctttccaccaatgccaaagccgttggcgagtttggtattgatactgccaacatgttcgagttctgggactgggttggcggccgttactctttgtggtcagcgattggcctgtcgattgttctctccatcggctttgataacttcgttgaactgctttccggcgcacacgcgatggacaagcatttctccaccacgcctgccgagaaaaacctgcctgtactgctggcgctgattggcatctggtacaacaatttctttggtgcggaaactgaagcgattctgccgtatgaccagtatatgcaccgtttcgcggcgtacttccagcagggcaatatggagtccaacggtaagtatgttgaccgtaacggtaacgttgtggattaccagactggcccgattatctggggtgaaccaggcactaacggtcagcacgcgttctaccagctgatccaccagggaaccaaaatggtaccgtgcgatttcatcgctccggctatcacccataacccgctctctgatcatcaccagaaactgctgtctaacttcttcgcccagaccgaagcgctggcgtttggtaaatcccgcgaagtggttgagcaggaatatcgtgatcagggtaaagatccggcaacgcttgactacgtggtgccgttcaaagtattcgaaggtaaccgcccgaccaactccatcctgctgcgtgaaatcactccgttcagcctgggtgcgttgattgcgctgtatgagcacaaaatctttactcagggcgtgatcctgaacatcttcaccttcgaccagtggggcgtggaactgggtaaacagctggcgaaccgtattctgccagagctgaaagatgataaagaaatcagcagccacgatagctcgaccaatggtctgattaaccgctataaagcgtggcgcggttaatcatcgtcgatatgtaggccggataaggcgttcacgccgcatccggcaaccgatgcctgatgcgacgcggtcgcgtcttatcaggcctacaggtcgatgccgatatgtacatcgtattcggcaattaatacatagcacgattgattaaataaccttaataacaatgccgacgttatgtcggcatttttttatcagataaatccccttgtctgtaatttaacggaaatcataccgtgaggttaatcctaaaatagatttttaatcgttgtttatttcggaaaatacgcagattaattgcttttgtttttattttaagtttatgatttttattgttatttaaatataagttgaaacttatatttgatattcattccaattatcctaaaacgccatcgctaattccccgcgccgtaattcgcatgctttagttgtgtatactcgatcccgcccgaaatgtttttgggtaaatctccattcattcaatgaagggaaattgttatgaaaaaagttctgtatggcatttttgccatatctgcgcttgcggcgacttctgcgtgggctgcacctgtacaggtgggcgaagcggcagggtcggcagcaacgtcggtttcggcggggagttcctccgcgaccagcgtcagcaccgtaagctcggcggtgggtgtcgcgcttgcggcaaccggtggcggtgatggttctaataccgggaccaccacaaccacgaccaccagtacccagtaataaagtatgtatccccaaaataattcgagtcattgcatctgtggctagaagtatgaagggattaaccataaccacactccggtgtggttattctgcccctctggagaagagtcgtgaagcgacctgcactcattcttatctgcctgttattacaggcctgttcagccacgactaaagagctgggcaattcactgtgggacagtctgttcggcacgccaggcgtacagctgacggatgatgatattcaaaatatgccctacgccagccagtacatgcagcttaatggcgggccgcagttatttgtggtgctggccttcgctgaagacggacaacaaaaatgggtcactcaggatcaggctactctcgttacccaacatggccgtctggtgaagactctgctcggcggcgacaacctgattgaagtgaataaccttgctgccgacccgctgattaaacccgcacaaatcgttgatggcgcaagctggacgcgcacgatgggctggaccgagtaccagcaggtacgctacgccaccgcacgctcagtcttcaaatgggatggcaccgataccgtcaaagtcggcagcgatgaaaccccggttcgcgtgctggacgaagaagtctccaccgaccaggcgcgctggcataaccgctattggatcgacagcgaagggcaaattcgccagtcggaacagtatctcggcgcggattattttccggtgaaaaccactctcatcaaggcggcaaaacaatgattaaacaaactattgtcgcgttgcttttgagtgtgggagcgtcatcggtcttcgcggcaggaaccgtcaaggtgttcagcaatggcagcagtgaggccaaaacgctaacgggcgcagagcatttaatcgatctggtaggccaaccgcggctggcaaacagctggtggcccggtgcggtgattagcgaagagctggcaacggcggcagcattgcgtcagcagcaggcgttgctgacacggctggcagaacagggcgcagattccagcgccgacgatgccgctgcgattaacgccttacgccagcaaattcaggcgttgaaagtgacgggcaggcaaaaaatcaatcttgatcccgatatcgtccgcgttgccgaacgcggtaacccgccgttgcagggcaactacacgctgtgggtcggaccaccgccgtccacggtcacgttgttcgggcttatcagccgtcctggcaagcagccattcactccaggtcgcgacgtggcgagctatctctctgaccagagcctgctcagcggtgcggatcgcagctacgcgtgggtggtttacccggacggacgcacgcaaaaagcgccggtggcttactggaacaagcgtcacgtagagccgatgcccggcagcattatttatgttggcctcgcggactccgtctggagtgagacgcctgatgcccttaacgccgacattcttcagactctgacgcagcggatacctcaataatgaaaaaaagacatctgcttagcttactggcgctgggcattagcacagcttgctacggcgaaacatatcctgcgcccattggtccgtcgcagtcggatttcggtggcgtaggattattacaaacgcccaccgcgcgtatggcacgggaaggggagttgagtctgaactatcgcgataacgatcagtaccgttattactcagcttcagtgcaactcttcccgtggctggaaacaacgctgcgctacaccgacgtgcgcacccggcagtacagcagcgtcgaagcgttctctggcgatcaaacgtataaagataaagccttcgatctcaaactgcgtttgtgggaagagagttactggctgccgcaagtggcggttggtgcgcgggatatcggcggtacggggctgtttgatgcggaatatcttgttgccagcaaagcctgggggccgttcgattttacgctcggcctgggctgggggtatttgggcaccagcggtaatgtgaaaaatccgctctgttcagccagtgataaatattgctatcgcgataacagctacaaacaggcgggatctatcgacggtagccagatgttccacggtcctgcctcactgtttggcggcgtggaataccagacgccctggcaaccgctgcgcctgaaactggagtatgaaggcaataattatcagcaggattttgccgggaagctggagcaaaaaagtaagtttaacgtcggtgcgatttatcgcgttaccgattgggccgacgttaaccttagctatgaacgtggcaacacctttatgtttggcgttacgttgcgcaccaactttaacgatctgcgcccgtcttacaacgataacgcccgcccgcaatatcaaccgcagccgcaggatgccattttgcagcattcggtggtggcgaatcagttaacgctgttgaaatacaatgccggacttgccgatccacagatccaggcgaaaggcgatacgctgtatgttaccggcgagcaggtgaaatatcgtgattcgcgcgaagggatcatccgtgcgaatcggatcgtgatgaacgatctgccggatgggatcaaaacgatccgcattacggaaaatcgccttaacatgccgcaggtgacgacggaaaccgatgtcgccagcctgaaaaatcatctcgccggagagccgttgggccacgaaacgacgctggcgcaaaaacgcgtcgagccagtggttccgcagtccaccgagcagggctggtatatcgacaaatcacgctttgatttccatatcgatccggtgctgaaccagtcggtcggtggcccggaaaacttttacatgtatcagctgggcgtgatgggaacggcagatttgtggctgacggaccatctgctgaccaccggcagcctgtttgcaaatcttgccaacaactacgacaagtttaactacactaatcctccgcaggactcgcacttaccgcgcgtgcgtacccatgtgcgcgagtatgtgcagaacgatgtctatgtgaataacctgcaagccaactacttccagcatctgggcaacggcttctacggtcaggtctacggtggttatctcgaaaccatgtttggcggtgcgggggcagaagtgttgtatcgcccgctggacagcaactgggcgtttggtctggatgccaactacgttaaacagcgcgactggcgtagtgcaaaagatatgatgaaattcaccgactacagcgtgaaaaccggacatctgaccgcctactggacgccatctttcgctcaggatgtgttagttaaagccagcgtcgggcagtatctggcaggggataaaggcggcacgctggagatcgccaaacgctttgatagcggcgtggtggtgggtggctatgccacgatcactaatgtttcgaaagaggagtacggcgaaggggacttcaccaaaggcgtgtatgtctcggtaccgttggatctcttctcgtctggcccgacacgcagccgtgcggcgattggctggacgccgctgacgcgtgacggtggtcagcaacttgggcgtaagttccagttgtatgacatgaccagcgaccgtagcgtcaatttccgctaagtcatgggaaaggtgccagttttcgcactcactggcaccttcattcttaatggcctgtcgagccatcaggaacgcagttcactcccggtttgcgatctggtgtgtaaaggcgaaaacattctgtcttcctgtccgtcgatatcggttgcaggtctggttgcctgagcgactgggccatcattgggctggagacattgctttgcggtaggtcggctttatcagcagtaccgagcggaccagcataagcaggaagaacagagactgataacatcaaagcagcaaaataaggcttcatttttaccacctttatcaggttacgtttcatttgttccagaggaacattgtcgatttttcgcgcattgctggtggctgggaatcacctgaatgggtgatttttgaattaccggctttggtgcggtttgtcttgccggatgcgccgccaggcgcggcttatccggcctacgggtaggtatatccggctttggtggaggcgcgctccaaatccaggttgaacaaaacatacacaaaaaatatagatctccgtcacatttttgcgttatacaggaagctcgccactgtgaaggaggtactgctatgacgtcactctctcgtccgcgcgtggagtttatctccaccattttgcagaccgtactcaatcttggcctgctgtgcctcggcctgattttggttgtcttcctcggcaaagaaacggtgcatctggctgatgtgctgttcgcgccagaacaaaccagcaaatatgagctggtagaaggactggtggtttactttctctatttcgaatttatcgcgctgattgtgaagtactttcagtccggttttcacttcccgctacgttactttgtctatattgggatcaccgccattgtgcgcttgatcatcgtcgatcataaatcgccactggatgtgttgatctactcggctgcgatcctgttactggtgatcaccctgtggctgtgtaattcgaaacggctgaagcgggagtaaaaagtcagcacgccgaaatggcgcggcgtgctggacaggaagattacagcgtagcagtttgttgtgttttcttcgtttccggttcccagagcgcttccagctcctcaagggttttacctttggtttccgggacaaatttccacataaacagtgctgccagaacgcccatacaaccgtaaatccagtaggagaaaccgttgtggaaatgggccaccagccaggagtttttgtccatcatcgggaaggtccaggagacgaagtagttcgccagccactgggccgccaccgcgattgccagcgctttaccacgaatagcattcgggaagatttccgacagcagtacccagcataccggaccccaggacatggcaaaggcggcaacatagaacagcatcgacagtagcgccacaatacccggtgcctgagtgtaaaacgcggtaccgaggctaaacataccgattgccattccgagtgcgccgataatttgcagtggcttacgaccaaatttatccaccgtcataattgccagaacggtgaaggtgaggttgataactccgacaataatggtctgcaacagcgcgatatccgtgctggcccccagcgttttgaacacttccggcgcgtagtacagcaccacattgatgccgacaaattgctggaagatggagagcattacgccgattacaatcacgcccacgccaaacatcagcagacgaccaccggttttgcggccatgatccagggagtgtttaatttcctgtactgcctgagttgcaagcgtgttgcccataattttgcgcaggataccttccgcctgttcttgcttgccgcgcgacatcagccagcgaggactttctggcacggtatacagcagcattaagaacagcagtgcagggatacattccgaggcaaacatataacgccagccgtcagtattcagccagctggcatcaccggaacgggcaataaaatagtttacgcagtaaactaaaagttgcccgaaaataatcgcaaactggttaaaagagaccagtttcccgcgaatatgagctggagccagttccgcaatatacattggcgagagcattgaggctaaaccaacgccaataccgccaataatgcgataaataacaaattccgggacataacctgccagataaacaggcacagtgttgtccgggtttatagaggtaaaaccaagttctggccaggcagaacctacaccagaaataaaaaacaggacagcagcaatcttaagtgaatcacgacgaccgaagcggttactgcaataaccaccgagggcaccgccgatgatgcaaccaatcagagcgctggccacgcaaaaccctaacagggagttggcagcggattcacttaagttttgtggagcaacaaagacggtattgagtgactcaacagtaccggaaataacggcggtgtcgtagccaaataataaaccacctaatgtagcgactaaggtaatcgaaaatatataactggaattatactgggtattcattcagacctgccttagaccattctgatcttttatcagtgcattgatgttggaattgtcaggcagttaaggcaattatcattttttacaatgcgtttacgtaatgtcttttctgtgatcttaattgtgataattatccaaaattgataaaaacaatactattgccgtgactcagagcacgaaagagaattatcgtaagtgggaaaacaaataacgtaaaaataataagctctatgatggaaatattaaccggcgaacgattcagattgcagacgaaagaaaaaaaggcgctccgtggagcgccgaataacagtcacaagttgggataacgtaagttgagggtgcagcggcataacattggcagaacaacatctttaacctttcacaccacctgccgtcaggccgttgaccagccagcgttgagccagcaagaagacgatggtgatcggtaatgcagacatcacggcagcggcggcaaagtcaccccacaggtagttttgcgggttgaggtattgctgcatccccacggccagggtgtagctgtttacgtcacgcagtaacagcgacgcgaccggaacttcagtaatggcagcgataaacgacaggatgaataccaccgccagaatcggtactgacagcggcaacaggacaaggcggaaggcctgccacggtgtcgcaccatccagcgcagcagcttcttccagcgaactgtcgatggtttcgaaatagcctttgatggtccagacatgcagcgcaatcccacccagatacgcgaaaattacgccgccgtgagtattcaggccaatgaatggaatgtactcacccagacgatcaaacaacgcatacaacgcgaccagtgaaagtactgccgggaacatctggaaaatcagcattcctttcagcagcgtcgctttgcctggaaagcgcatacgggcgaaagcgtaggcgcaggtggtggagagcgccacaatgccaatcgcggaaatcccggcgacctttaccgagttccacagccacagcagtaccgggaatggcggtggcgtaatgcgaccatcagcctgttcaacgctaaaacctaacgccagtttccagtgatcccaggagatttgctccgggatcaggctgccggtcgcaaagtttccctgacgcagcgagatagcgacgaccatcagcagcgggaacataatcgctgcgataaaaagtagcagtagcaggtgagtaataaataaacgagctttttgcgatttcggttggaccattgccatttttgttatctcccttaatcaaacttcattcgcgtggctttcaggttcactatcgccagcgcacccaccagcaggaagatcagcgtggcaattgctgccgccagaccgaagtcctgacccccgccgccttcaaaagcgatgcggtaggtgtagttaacaagcaggtcggtataaccggctggcgtggtcgtgccaagacgatccgggccgccgttggttaacagttgaatcagcacgaagttgttaaagttaaaggcgaagctggcgatcatcagcggcgtcagcggtttaatcagcagcggcagcgtaatcttaaagaagttctggaacggacctgcgccatccattgctgaggcttcatacaaatcgtccggaatcgctttcagcaagcccatgcagaggatcatcatgtacggataacccagccaggtattgacgataattagcatcgtgcgggcggtggtcggatcgctgaaccaggcgggcttcacgccaaacagcgcgctcaacatcatgttgatttcaccgaagctctggttaaacaaccctttgaaaatcaagattgaaatgaacgatggcaccgcgtagggcagaatcagcaggacgcgatagaccgctttgccgcgcaacgcttcccactgcaccagacacgccagaaccatgccgaccgccaccgttaaaaagacagtgatcagcgagaacaccacggtccagacgaaaatggcgaggaacggtttctgaatgccttcgtcggtaaagacgcgggtaaagtttttccagccggtggtcacggtgtaaccggggcttagcttttcatcaccccagttgccgtcggcggtaatggactggtaaaagccaatttggttattcggacgatatttcacgccgctctgattattcgtcaacgtgccgtcaccgtcgagtgtgtagagcggctgcgtgccagaaaactggcgcagggagctcatcatcactttgttgccatccggcagaatggcggtaatgtcactcagcgcctgacgattctgggtaatcacgcgcagattcgcgcgttcgccttcgggctgggcggtcgtttctttcagttgcagtttttgctcgccgccaaatttaaaagcgtcggagaggtaatttttgccggtttcgccgtcgctgagcgccagttgccactcatcgcccgccgggtaaagaccaaagttataggttttgcctgcttgccaggagcgatctaacaacacttcctgcgcacgttcaaaagtcagctggttagtgctgctgtagttggtgaaggcaatggcgatggtgcagaccagagggaagaggacgaataatcccattccagccattcccgggtaaacatagcgccaggcgtaggctttacgattggcgaaaatatacagccccgctgaactcaatatcagcgtggtaatggcgaacaggtattccccttgtgcgtacattaaaacaacaaggtaacccaccagcaggccgagcagacctagcactgaccatttcagcgcgtcgctttgccaccaatgtttctttttaatgacatccatggggttcttcctcattccaggacggataaggctttcacgccttatccgacaacaactgcctgatgcgacgctgacgcgtcttatcaggcctacatacgtttcggttttgtaggccggacaaggcgttcacgccgcatccggcatttcacagcattacttggtgatacgagtctgcgcgtctttcagggcttcatcgacagtctgacgaccgctggcggcgttgatcaccgcagtacgcacggcataccagaaagcggacatctgcgggatgttcggcatgatttcacctttctgggcgttttccatggtggcggcaatacgtggatctttcgccaactcttcctcgtaagacttcagcgctacggcacccagcggtttgtctttattaaccgcttccagaccttcatcagtcagcagatagttttcgaggaactctttcgccagctctttgttcggactggcggcgttaatacctgcgctcagcacgccaacgaacggtttggatggttgacccttgaaggtcggcagtaccgttacaccataattcactttgctggtgtcgatgttggaccatgcccacgggccgttgatggtcatcgctgtttcgcctttattaaaggcagcttctgcgatggagtaatcggtgtctgcattcatgtgtttgtttttaatcaggtcaaccaggaaggtcagacccgctttcgcgccagcgttatccacgcccacgtctttaatgtcgtacttgccgttttcatacttgaacgcataacccccgtcagcagcaatcagcggccaggtgaagtacggttcttgcaggttgaacatcagcgcgctcttacctttcgctttcagttctttatccagcgccgggatctcttcccaggtttttggcgggttcggcagcagatctttgttataaatcagcgataacgcttcaacagcgatcgggtaagcaatcagcttgccgttgtaacgtacggcatcccaggtaaacggatacagcttgtcctggaacgctttgtccggggtgatttcagccaacaggccagattgagcgtagccaccaaagcggtcgtgtgcccagaagataatgtcagggccatcgccagttgccgcaacctgtgggaatttctcttccagtttatccggatgctcaacggtgactttaattccggtatctttctcgaatttcttaccgacttcagcgagaccgttatagcctttatcgccgttaatccagattaccagtttaccttcttcgattttggcgagagccgaggcggaaaacatcatcgtcgttaatgcggataatgcgaggatgcgtgcacctgtttttattttcataatctatggtccttgttggtgaagtgctcgtgaaaacacctaaacggactctagtttctttatacggcaacctctttccatcctccttgcccctacgccccaccgtcgctttgtgtgatctctgttacagaattggcggtaatgtggagatgcgcacataaaatcgccacgatttttgcaagcaacatcacgaaattccttacatgacctcggtttagttcacagaagccgtgttctcatcctcccgcctcctcccccataaaaaagccagggggtggaggatttaagccatctcctgatgacgcatagtcagcccatcatgaatgttgctgtcgatgacaggttgttacaaagggagaagggcatggcgagcgtacagctgcaaaatgtaacgaaagcctggggcgaggtcgtggtatcgaaagatatcaatctcgatatccatgaaggtgaattcgtggtgtttgtcggaccgtctggctgcggtaaatcgactttactgcgcatgattgccgggcttgagacgatcaccagcggcgacctgttcatcggtgagaaacggatgaatgacactccgccagcagaacgcggcgttggtatggtgtttcagtcttacgcgctctatccccacctgtcagtagcagaaaacatgtcatttggcctgaaactggctggcgcaaaaaaagaggtgattaaccaacgcgttaaccaggtggcggaagtgctacaactggcgcatttgctggatcgcaaaccgaaagcgctctccggtggtcagcgtcagcgtgtggcgattggccgtacgctggtggccgagccaagcgtatttttgctcgatgaaccgctctccaacctcgatgctgcactgcgtgtgcaaatgcgtatcgaaatctcccgtctgcataaacgcctgggccgcacaatgatttacgtcacccacgatcaggtcgaagcgatgacgctggccgacaaaatcgtggtgctggacgccggtcgcgtggcgcaggttgggaaaccgctggagctgtaccactatccggcagaccgttttgtcgccggatttatcggttcgccaaagatgaacttcctgccggtaaaagtgaccgccaccgcaatcgatcaagtgcaggtggagctgccgatgccaaatcgtcagcaagtctggctgccagttgaaagccgtgatgtccaggttggagccaatatgtcgctgggtattcgcccggaacatctactgccgagtgatatcgctgacgtcatccttgagggtgaagttcaggtcgtcgagcaactcggcaacgaaactcaaatccatatccagatcccttccattcgtcaaaacctggtgtaccgccagaacgacgtggtgttggtagaagaaggtgccacattcgctatcggcctgccgccagagcgttgccatctgttccgtgaggatggcactgcatgtcgtcgactgcataaggagccgggcgtttaagcaccccacaaaacacacaaagcctgtcacaggtgatgtgaaaaaagaaaagcaatgactcaggagatagaatgatgattactctgcgcaaacttcctctggcggttgccgtcgcagcgggcgtaatgtctgctcaggcaatggctgttgatttccacggctatgcacgttccggtattggttggacaggtagcggcggtgaacaacagtgtttccagactaccggtgctcaaagtaaataccgtcttggcaacgaatgtgaaacttatgctgaattaaaattgggtcaggaagtgtggaaagagggcgataagagcttctatttcgacactaacgtggcctattccgtcgcacaacagaatgactgggaagctaccgatccggccttccgtgaagcaaacgtgcagggtaaaaacctgatcgaatggctgccaggctccaccatctgggcaggtaagcgcttctaccaacgtcatgacgttcatatgatcgacttctactactgggatatttctggtcctggtgccggtctggaaaacatcgatgttggcttcggtaaactctctctggcagcaacccgctcctctgaagctggtggttcttcctctttcgccagcaacaatatttatgactataccaacgaaaccgcgaacgacgttttcgatgtgcgtttagcgcagatggaaatcaacccgggcggcacattagaactgggtgtcgactacggtcgtgccaacttgcgtgataactatcgtctggttgatggcgcatcgaaagacggctggttattcactgctgaacatactcagagtgtcctgaagggctttaacaagtttgttgttcagtacgctactgactcgatgacctcgcagggtaaagggctgtcgcagggttctggcgttgcatttgataacgaaaaatttgcctacaatatcaacaacaacggtcacatgctgcgtatcctcgaccacggtgcgatctccatgggcgacaactgggacatgatgtacgtgggtatgtaccaggatatcaactgggataacgacaacggcaccaagtggtggaccgtcggtattcgcccgatgtacaagtggacgccaatcatgagcaccgtgatggaaatcggctacgacaacgtcgaatcccagcgcaccggcgacaagaacaatcagtacaaaattaccctcgcacaacaatggcaggctggcgacagcatctggtcacgcccggctattcgtgtcttcgcaacctacgccaagtgggatgagaaatggggttacgactacaccggtaacgctgataacaacgcgaacttcggcaaagccgttcctgctgatttcaacggcggcagcttcggtcgtggcgacagcgacgagtggaccttcggtgcccagatggaaatctggtggtaatagcaaaacctgggccggataaggcgtttacgccgcattcggcaaccaacgcctgatgcgacgcttgcgcgtcttatcaggcctacaacggctgtcaaatgtaggccggataaggcgtttacgccgcatccggcataaaaacaggttgtcattatctgaaaggggcgaaagcccctctgattatcgggtttagcgcgctattgcctggctaccgctgagctccagattttgaggtgaaaacaatgaaaatgaataaaagtctcatcgtcctctgtttatcagcagggttactggcaagcgcgcctggaattagccttgccgatgttaactacgtaccgcaaaacaccagcgacgcgccagccattccatctgctgcgctgcaacaactcacctggacaccggtcgatcaatctaaaacccagaccacccaactggcgaccggcggccaacaactgaacgttcccggcatcagtggtccggttgctgcgtacagcgtcccggcaaacattggcgaactgaccctgacgctgaccagcgaagtgaacaaacaaaccagcgtttttgcgccgaacgtgctgattcttgatcagaacatgaccccatcagccttcttccccagcagttatttcacctaccaggaaccaggcgtgatgagtgcagatcggctggaaggcgttatgcgcctgacaccggcgttggggcagcaaaaactttatgttctggtctttaccacggaaaaagatctccagcagacgacccaactgctcgacccggctaaagcctatgccaagggcgtcggtaactcgatcccggatatccccgatccggttgctcgtcataccaccgatggcttactgaaactgaaagtgaaaacgaactccagctccagcgtgttggtaggacctttatttggttcttccgctccagctccggttacggtaggtaacacggcggcaccagctgtggctgcacccgctccggcaccggtgaagaaaagcgagccgatgctcaacgacacggaaagttattttaataccgcgatcaaaaacgctgtcgcgaaaggtgatgttgataaggcgttaaaactgcttgatgaagctgaacgcctgggatcgacatctgcccgttccacctttatcagcagtgtaaaaggcaaggggtaattacgccccacagtgctgattttgcaacaactggtgcgtctcctggcgcacctttttttatgcttccttcctgggatatgagcgattttttatagtaactcacttcttcttcactaagaatatccattatctcaatgccttatcagagattcttttcctttcgccggtagtgtctggacattcaggctacttttccaggttattttatttctgttatgcagaggttttatgataagtcatatcctaaattctggcggcaataactctttgatgaaacatgatgtggtgcaaggaaataatatagtagatcttgatttactacgtaatttaaatggggtgccaggtttaaacagagataactttatttatatcagcaatattttttcaaatataaaacaacggaacgaaaaaatcatgcaataaatatgtttcgtgaagtctcaatcagtaatgatactataagtgtaaaattctacagaaatgaaaaaaattgaatgcgcttgcaattttctgatggataaagatgcgcaggggtatatcgacctgtctgatttggatttaacaagttgtcattttaaaggtgacgttatatcgaaggtgtcttttttatcatcaaatctacaacatgtaacattcgaatgtaaagaaattggggattgcaattttactactgcaatagttgataatgtcatatttagatgtcgacgtttacacaatgtgatttttatcaaagcgagtggtgaatgtgtcgatttcagcaaaaatattcttgatacagttgacttctcgcagagtcaacttggtcatagtaattttcgcgaatgtcagattagaaattcaaacttcgataattgttatctttacgcttcgcacttcaccagagcagagtttctgtctgccaaagaaatatcatttattaaatcgaatttgacagctgttatgtttgattatgtgcgaatgtcgacagggaattttaaagattgcattacagaacaattggaattaactattgattattcagatatattttggaatgaagatctcgatggttatatcaataacattataaaaatgattgatacattgccagataatgcaatgatattgaaatccgttctggccgtaaaactggtgatgcaattaaaaatacttaatattgttaataaaaactttattgagaatatgaagaaaatatttagccattgtccttatataaaagatcccattatacgcagttatatccattctgatgaagataacaagttcgatgattttatgcgtcaacatcgattcagtgaggtgaatttcgatacccaacagatgatcgattttattaacagatttaatacgaataaatggctaattgataaaaataacaatttttttatccaacttatcgatcaggccttacgatcaacggatgatatgatcaaagcaaatgtttggcatctttataaagagtggattcgtagtgatgatgtttcacctatatttatagaaactgaagataatttaagaacctttaacacgaatgaattaacacgaaacgataatatctttatcctgttctcctcagtcgatgatgggccagttatggtggtaagctcccagcgcttacatgatatgttgaatcctacaaaagataccaattggaattccacgtatatctacaaatccagacatgagatgttgcctgttaatcttactcaggaaacacttttcagctccaaatctcatggtaaatatgcgcttttccccatttttactgcgagttggcgagctcatcgtataatgaataagggtgtttaagtaaaggaaaacatcaccgttcctggcatcctggacggtgatgcccctacggttgccctcgccagcacgggcatcggtaaagcgtaaggttcaacatcgttttaccacttcatgcgattgttgcgtttttgttgcgtattagatcacttaatttgctttacatctcccgtaaacacttttctgcgatacaatgcctttacgttatgtaacggagagttcggcatgtcacaccccgcgttaacgcaactgcgtgcgctgcgctattgtaaagagatccctgccctggatccgcaactgctcgactggctgttgctggaggattccatgacaaaacgttttgaacagcagggaaaaacggtaagcgtgacgatgatccgcgaagggtttgtcgagcagaatgaaatccccgaagaactgccgctgctgccgaaagagtctcgttactggttacgtgaaattttgttatgtgccgatggtgaaccgtggcttgccggtcgtaccgtcgttcctgtgtcaacgttaagcgggccggagctggcgttacaaaaattgggtaaaacgccgttaggacgctatctgttcacatcatcgacattaacccgggactttattgagataggccgtgatgccgggctgtgggggcgacgttcccgcctgcgattaagcggtaaaccgctgttgctaacagaactgtttttaccggcgtcaccgttgtactaagaggaaaaaaatatggagtggagtctgacgcagaataagctgctggcgtttcatcgcttaatgcgtacggataagccaattggcgcgttactgctgctctggccaacattatgggcgttgtgggtggcgacaccgggcgttccccagctctggatcctggcggtgtttgtcgcgggtgtctggctgatgcgcgctgccggatgtgtggtgaatgattatgctgaccgcaagtttgatggtcatgttaagcgcacggcgaaccgaccacttcccagcggcgcggtaacagagaaagaggcgcgcgcgctgtttgtcgtgctggtactgatttcgtttttactggtgctgacgctgaatacgatgaccattctgttgtcgattgccgcgctagcgctggcgtgggtgtacccgtttatgaagcggtatacccatctaccgcaagtggtgctgggcgcggcgtttggctggtcgattccaatggcttttgccgctgtgagtgagtcggtgccattgagttgctggttaatgttcctcgccaatattctctgggcggtggcttacgacacgcagtatgcgatggttgaccgcgatgatgatgtgaagattggcattaaatccacggcaatcctgttcggccaatacgataaattgattattggtattttgcagattggcgtactggcactgatggcgatcatcggtgagttaaatggcttaggctggggatattactggtcaattctggtggctggcgcgctgtttgtttatcaacaaaaactgattgccaaccgcgagcgtgaagcctgctttaaagcatttatgaataataactatgttggtctggtactatttttagggctggcaatgagttactggcatttctgatgatgtaaaaaagccggatgatcatccggctttcttctgggttgcctgatgcgcggcgcttctcaggcctacacaacacatcgcaatttattgaatttgcagattatggaaggccggataaggcgttttcgccgcatccggcaattctctctgattacccttcgccctgcgtcgcactctcaatcgtcaaacgcacgtctgatgtaatcaactccgccagcaactgataaaccttcatcgtttctgccggttcggcatcgccgctatcgctgatatacccttcatcacgcagtgtcagcaccagagaactgaacaccgccttgtcgaagaactccggcgcgttgatgccgtgcagcacggagagacgttgcgcgacggtgcggctctctttctccagcgtaccgcggttgatcgacgggttggcactcaacaaccagaaggtgatggcataacgttgcagcgtttcgcgcgcgcctgcggccagcagctgtagcgtgcgagaatgcgccgggttgatatgcaactcatcatcttgcagggtaatcagcccctgacgttgcatctcatttgccagcgcatcaataacgtccggcaactcgtcgcgatcccagcgcaggaacagctccgctttcagcattgggtaaagcacattgacgtgctccatcaatacgtcgcgggagatgtggcgatgctgggtgacgattgccgccatcagcgaaggcagcaccaacatatgcgcaatgttgttgcgatagtaggtcatcagcaccgcttgctcgcgcggcagaatgatgatgtcgccgattgtgtctttctcgacttcaaacttgttcatttgcagcgcgtgatcgataagctcgctggcgctggctgaaggaacggtagagtccgtggagtagggcacgttgcgcatcagatccaggtagcagttgagttgctcggttaactgctcgcgggtgagtgagcgctgacgtgatgccagtagcgcagtacagcacaggttcatggcgtttgccgcgcctgcgttgttaatgcgtaccatcagatcggcagcaatattattgaccgtcggcgttaaccatgccggacgcaccgcttcgatgggatcgatagattcacgccagtcaggtacatgctggttaaggtaggtcatcaacggcattggttcaccgaagttgacgtaaccctgaccgagattacgcagcttgcttaaaccgcgcagcatctgcggcaggctctctttctctttcgtcgcgccgcgcagttctttggcgtaagtacccacttccatgacgtgctcataaccgatatagatcggaatcagcgtaatcggacgcgtgccgccacgcagcatcgcctgaatggtcatcgacagcgtaccagttttcggatccagcaaacgccccgtacgggaacgaccgccttccacgaagtactcgacggaataaccacggctgaacagttcgccgagatactcccggaaaacggtggaataaagtttattgcctttaaacgtacggcgaataaagaacgcccccagacggcggaaaatcggcccggcaggccagaaattcaggttgatcccggcggcgatatgcggcggcaccagcccctggtgatacagcacgtaagaaagcagcaggtagtccatgtgactgcggtggcaaggcacatataccagctcatgaccgtcgtgggccagctggcgaacgcgctcagcgttatggacgttgatgccctggtaaagtcggttccaggtgaagcccagaatacggtcagtcaggcgaatcatctcgtaagagaaattcgccgcaatctcttccatcagtgcaatcgcgttctgctgcgctttttcatgggagatttttttgctgcgcgcttcatcttctaccgctttggcaatggcgcgggaggcgagcagcttattaaacagatcctgacgagcaggcaaacgtgggcctacggcagccagacgttgacgggcaaagtgcatacgcgccacgcgcgccagtttctgagcgatagttttatccgtgccgtgttcatccgccatacggcgcagcgaaactgacggcgagaaacgcacaaaactgtcgcgaccgagccacagtacagcgaaaaatttctgtacgccgttaagcatacgcagcggcgggttcacttcgcctttttcacgccccggcgcgcgaccaaacatcaccgacactggcaccatctgcacatccagatttgggttgctacggtgcaaatcgagatagtcgtggaacagcttaatagactcttctttcggcgtgtaataggtgaacacacgcggcccgccgtgaatgaacacatagcgcggcagtagcgtgccgtcgatttccagcggctctaacgggtcaggcaagtcatgtgccagacactgggcgcgcaacgtcagcaaatctgctttcgagttgtacggtaaaacgtacataattggacgagaggtatccagccccagttccggggcaggatctgccggaatagacttgctttttaccaggatgcttaatggtaaattcagtaatttgtagtaaattcgtggccagccggacataaacgatgtaaagcctctggttaataatgcaaatgcgcggcaaggatagcagaaagtcatgggaaattctgtggtatccgctcatgtttcgcgcggcgctacgcaaacccgaatcatcggatttaacggtacactgatattgacgctcataatgtaaaaaggttctttcaatggccaataataccactggattcacccgaattatcaaagctgctggctattcctggaaaggtttacgcgctgcatggatcaacgaagcggcattccgtcaggaaggcgtagcggtattgttggcggtggtcatcgcctgctggctggatgtggacgcgattacccgcgtgctgcttatcagctccgtgatgctggtgatgattgtggaaatcctcaatagcgccatcgaagcagtggttgaccgaattggctctgaataccatgagctttccggacgcgcaaaagatatgggatccgctgcggtgctgattgccattatcgtcgccgtgattacctggtgcattctgttatggtcgcattttggataacccttccagaattcgataaatctctggtttattgtgcagtttatggttccaaaatcgccttttgctgtatatactcacagcataactgtatatacacccagggggcggaatgaaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtctgttgcaggaagaggaagaagggttgccgctggtaggtcgtgtggctgccggtgaaccacttctggcgcaacagcatattgaaggtcattatcaggtcgatccttccttattcaagccgaatgctgatttcctgctgcgcgtcagcgggatgtcgatgaaagatatcggcattatggatggtgacttgctggcagtgcataaaactcaggatgtacgtaacggtcaggtcgttgtcgcacgtattgatgacgaagttaccgttaagcgcctgaaaaaacagggcaataaagtcgaactgttgccagaaaatagcgagtttaaaccaattgtcgttgaccttcgtcagcagagcttcaccattgaagggctggcggttggggttattcgcaacggcgactggctgtaacatatctctgagaccgcgatgccgcctggcgtcgcggtttgtttttcatctctcttcatcaggcttgtctgcatggcattcctcacttcatctgataaagcactctggcatctcgccttacccatgattttctccaatatcaccgttccgttgctgggactggtcgatacggcggtaattggtcatcttgatagcccggtttatttgggcggcgtggcggttggtgcaacggcgaccagctttctctttatgctgttgctgtttttacgcatgagcaccaccgggctgactgcgcaggcttatggtgccaaaaatcctcaggcattagcccgtacgctggtgcaaccgttgctgttggcgttgggggctggggcgttaattgcgctgctgcgtacgccgattatcgatctggcgctgcatattgttggcggtagtgaggcagtcctggaacaggcgcggcgctttcttgaaatccgctggttaagcgcaccggcgtcgctggcgaatctggtattactcggttggttactcggcgtgcaatatgcccgtgcgccagtaattttgttagtggtcggcaatatcctcaacattgtgctggatgtctggctggtgatggggctgcatatgaacgtgcagggcgcggcgctggcgacggttattgcggaatatgcaacattgctgattggtctgctaatggtgcgtaaaatcctcaaactacgcggaatttccggcgaaatgctgaaaactgcctggcgaggaaacttccgtcgcttgctggcgcttaaccgcgatatcatgctgcgttcgctgttgttgcaactctgtttcggcgcgatcaccgtacttggcgcgcgactggggagtgacattatcgctgttaacgcggttctgatgacgctactcacctttaccgcctatgcgctggatggttttgcctacgcggttgaagcgcactccggtcaggcatacggtgcgcgcgacggtagccagttgctggatgtctggcgggcagcgtgccgccagtcggggatcgtagcgttactgttttcggtggtttatttgctggctggggaacacatcattgcgttactgacgtcgttaacccagattcagcagctggctgaccgctatcttatctggcaggtgattttgccggtggttggcgtctggtgttatctgctggacggcatgtttataggcgcaacgcgtgccaccgaaatgcgtaacagtatggcggtggccgccgcaggttttgcgctgacgctccttacgctgccgtggctgggtaatcatgctttgtggctggcattaaccgtctttctggcgttgcgcgggctttctctggcggctatctggcggcgtcactggcgcaatggtacctggtttgccgcaacgtgacggttaaaaattctgaataaataatcctaagccaaattgctgactacacttaatctcacgttcagaagaaaagtgaacgtactctcattcacaacctaacgatgaggtcttgattatgaataaagatgaagccggcggtaactggaaacagtttaaaggtaaagtgaaagagcaatggggcaaactgaccgatgatgatatgacgatcattgaaggtaaacgtgatcaactggtcggtaaaatccaggaacgttatggttatcagaaagatcaggcagaaaaagaggtcgtggattgggaaacccgcaatgaatatcgctggtaattaatccctcctgcccgacgtgtacaaggatgtacgccctcttaacgcggtttctttttcacctgcacagagtgatcatgctggcactgttcaggatgacgacacgcttccacttctacacatgccgcacagagcccatgtgcttcaatcacattatgccgcagggcaaaccccatttttgccgccagcgtatgcataatgtcttccacgccttctgcacactcttctttcactgcgccgcagcgatcgcaaataaacatggctgacgtatgggtgggctgatcgaacagatgacagagcacataactgttggtggattccaccttatgcacaaaaccttgctcaagcagaaaatccagcgcgcgataaaccgttggcggcttggcttgcggttcagcttcgcgcagtaaatcaagcagatcataagcgctgatagcgccatcctgcagactcatcaggcgcaacacttccaggcgctgtggggtcaggcgcacattacgctgcgcgcagattttttcagcctgcgctaataactcctgcgttgtggtcttttccatcgggcacctcaaagtgggggttaagaatgtccttactttaccatgttccaggaaaaacaccgagaacccttattgttgccgtaatgttgattttctgttttgtaggtaaggtgttatgttgccttgtcgtaccattatcaacacgataataattaataattcatttttaaataaattgcttcaagttaactcgctatttatttaactgggtttaaacgcatacctgtagttcagaaattatgagcgatttttgatagtgaccagatggcaaaagaattataaggaggacacggtacgacaaaaaaggtagatgaatcatgttgaagataatacccggtgcaactggatactttaataaaacactcaattcaaatcaattcgataatgaagatgcaatcaaagataaattagataatagaggttcaatcaaaggtaaattaaataatatatatggtaaatctattgattatgcagcgctgcgtcatcgggatataattattgcaaaaatagatttgtttattcaacgaatcacgcataatttatggcatgcacgtaaaaaaatgtgtttttaattgtgcaaataaatgatctcaaaatgtgggtcaataagtatattgacgattgcactgatgaggatttaaacgatcgtgactttattgcatcagttgttgaccgggctatttttcatttcgcgattaatagtatatgtaatcctggggataataaagatgcaatgcccattgaacaatgtacttttgatgtagaaactaagaatgaccttccctccacggttcagctattttatgaggaatctaaggataatgaacctttagcgaatatacattttcaagcaataggttctggttttttaacgtttgttaatgcctgccaggaacatgatgacaacagcttaaaattatttgcttcgctgttaatttcactttcatattctagtgcctacgcagatttatcagaaacagtgtatattaatgaaaataatgagagctacctgaaagctcagtttgaaaaattatctcaacgtgatatgaagaagtacctgggagagatgaagcgtctggctgatgggggagaaatgaattttgatggctatctggataagatgtcacatctggtgaatgaaggaacgctcgatcctgatattttaagcaaaatgcgagatgctgcaccacaattaattagcttcgcgaagtcgtttgacccaacctcaaaggaagagattaaaatacttacagacacttctaaattaatttatgatttgttcggggttaaatcggagaaataatatgtgaagttcttcgatagtatggaaggcattatataaaaggacccaatatttattgggttcttttttctctatcaatactattagcagggagatatatcaccagagtttaatgtgtgattttttatttatcgtcgaacctggattgtttatcattggccttaacaaagttaacggctaataagattatttccatcacttcgtgagagcttcatgccttgagaggatctcaattttcttttgcaatgagacaggcgcttcctgttgttatggtatagtaccccgctattgagcctcctgaatagtgatgctgaataacataaccccatgatatatcgataaaataatctctacatttgaaaatgcacggtaattctgaaatgcaaaaaatcaaccaaaccagcgcaatgcctgaaaaaactgacgttcactggagtggtcggtttagcgttgcaccaatgctcgactggacggacagacattgccgctatttcttgcgtctgctttcccgcaatacgttgctgtataccgaaatggtgaccacaggggcgattattcacggtaaaggtgattatctggcgtacagtgaagaagaacatccggtagcgttgcaactgggcggtagcgatccggcggcgctggcgcagtgtgcaaagctggcagaagcgcgcggatatgatgagatcaacctgaatgtcggctgcccgtctgaccgggtgcagaacggcatgtttggtgcgtgtctgatgggtaatgcgcagctggttgccgactgcgtgaaagcgatgcgcgatgtggtgtcgattccggtgacggtgaaaacgcgtattggcatcgacgaccaggacagctatgaatttctctgcgatttcatcaataccgtttccggcaaaggcgagtgtgagatgttcatcatccacgcacgtaaagcctggctttcggggttaagcccgaaagaaaaccgtgaaatcccgccgctcgattatccgcgtgtgtatcaactgaagcgtgactttccgcatctgacaatgtcgattaacggtggtatcaagtcgctggaagaggccaaagcacacctgcaacatatggatggcgtgatggtcgggcgcgaggcgtatcagaatccgggtattctggcggcggtagaccgggagatctttggttcctcggataccgatgccgatccggtggcggtagtgcgcgccatgtatccgtacattgagcgtgaactcagccaggggacgtatctcggccatattacccggcatatgttgggcttgttccagggtattcctggcgcgcggcagtggcggcgttatttaagtgaaaatgcccataaagcgggtgcagacattaatgtgctggaacacgcgctcaaactggtggcggataagcgttaacttttcaccaaaaagtagtcaaattcaccacgccctgcgcaccgtcgcggggcgttttgctgttaaatcaatagattatttttggcatgattcttgtaatgccagcaagagatttcatatttgggagagcatcatgctggaactactttttgtgattggcttttttgtcatgctgatggtcaccggcgtttcgttgctgggcattatcgccgcgctggttgtggcgacggccattatgttcctcggcggtatgctggcattgatgattaagttgctgccgtggttactactggcgattgcggtggtgtgggttattaaggcgattaaagcaccaaaagtgccgaaatatcagcgttatgaccgctggcgttactaagggattgtgcggatgatcacaacctaaggttttatccttagaacaaaataggaattgataatcaaatctgtcactattgcgcctctaacagattcatcgtgctgtaccctacatacagccgaactataaaaagaaagggcttcccaggtggaagccctatttcttttatggaatcagcaggctggaaccttgcgtcgcccggctttccagaatctcatgcgcacgctgcgcatccttcagcggatatttctgctgctcggcgacatcgaccttaatcacaccgctggcaatcaaagagaacagttcattactggcctcggttaattcctcccgcgtggtgatatagccttgcagggaagggcgtgtcacatacaacgagcctttttgattgagaatgcctaagttcacaccggtaaccgcacctgatgagttgccaaaactgaccattaagccgcggcgttgcaggcaatccagcgaccgttcccaggtgtctctgcccacggaatcgtacaccacgcgcactttcttaccgccggtgatctcttttaaccgctcgaccagatcctcttcacgatagttaataacctgccacgcgcccgcttttagcgcgctctgcgctttttgcgcggttcctacggtgccgataagtttcgcgcccagggcttttgcccactggcaggcaattaagccaacgccgccagccgctgcgtggaacaggaactgttcatcgggtttaatttcataggttttgcgcagcagataataaaccgttaagcctttcaggaaggatgccgcagcttgctcaaaagaaattgccgcaggcagaatcgccgctttatccgcaataatgttatgcacagagctgtaagcgcctaacgccgactgcgcatagactacacgatcgcctgccttaatatgctttacaccactgccgactttactcacgatgcctgctgcttcggtgcctaatccgctgggtagcgatggcggcgggtaaaggccgctgcggatatatgtgtcgataaaattgatgccgatggctttattttcgacctggatttcattctccgccggatcggcaggagtgaactctacggcttgaagtacttccgggccaccgtgcttgtgaaattcaattcgtgttgccatgtgtcctccagaacgtatcgtcagggtctgcttcatatgataaagtttcgacccattctttatctcggtaactccattcactatggcaggaaataaacccttcaacaaacagcaggctgaaccccgcgaacgcgatccacaagttgccgggctgaaagtgcctccgcactcgatcgaagcggagcagtcggtgttgggcggtttaatgctagataacgaacgctgggatgatgtagccgagcgtgtggtagcagacgatttttacacccgcccacaccgtcatatctttactgaaatggcgcgtttgcaggaaagcggtagccctatcgatctgattactcttgcggaatcgctggaacgccaggggcaactcgatagcgtcggtggttttgcttatctggcagagctgtcaaaaaatacgccaagtgcggctaacatcagtgcctatgcggacatcgtgcgtgaacgtgccgttgtccgtgagatgatctcggttgcgaatgagattgccgaagctggttttgatccgcaggggcgtaccagcgaagatctgctggatctggctgaatcccgcgtctttaaaattgccgaaagtcgtgcgaacaaagacgaagggccgaagaacatcgccgatgtgctcgacgcaaccgtggcgcgtattgagcagttgtttcagcagccacacgatggcgttaccggggtaaacaccggttatgacgatctcaacaaaaaaaccgctggcttgcagccgtcggatttgatcatcgtcgccgcgcgtccgtcgatgggtaaaacaacatttgcgatgaacctcgtcgaaaacgcggcgatgttgcaggataaaccggtacttatcttctcgctggagatgccatcagaacagatcatgatgcgttctctggcgtcgctgtcgcgcgttgaccagactaaaatccgtaccgggcagctcgatgacgaagactgggcgcgcatttccggcaccatgggtattttgctcgaaaaacgcaatatctatatcgatgactcctccggcctgacgccaacggaagtgcgttcccgcgcacgccgtattgcccgtgaacacggcggcatcgggcttatcatgatcgactacctgcaactgatgcgcgtaccggcgctttccgataaccgtacgctggaaattgcagaaatctctcgctcgctgaaagcactggcgaaagaactgaacgtgccggtggtggcgctgtcccagttgaaccgttctctggaacaacgtgccgacaaacgcccggtcaactccgacctgcgtgaatctggctctatcgagcaggatgcggacttgatcatgtttatctatcgtgatgaggtgtatcacgaaaacagtgatttaaaaggcatcgcggaaattattatcggtaaacaacgtaacggcccaatcgggacggtacgcctgacctttaacggtcaatggtcgcgcttcgacaactatgcggggccgcagtacgacgacgaataataattattttatgaattaggtaattaaagcaaacacttatcaaggaacacaaatgcaagcggcaactgttgtgattaaccgccgcgctctgcgacacaacctgcaacgtcttcgtgaactggcccctgccagtaaaatggttgcggtggtgaaagcgaacgcttatggtcacggtcttcttgagaccgcgcgaacgctccccgatgctgacgcctttggcgtagcccgtctcgaagaagctctgcgactgcgtgcggggggaatcaccaaacctgtactgttactcgaaggcttttttgatgccagagatctgccgacgatttctgcgcaacattttcataccgccgtgcataacgaagaacagctggctgcgctggaagaggctagcctggacgagccggttaccgtctggatgaaactcgataccggtatgcaccgtctgggcgtaaggccggaacaggctgaggcgttttatcatcgcctgacccagtgcaaaaacgttcgtcagccggtgaatatcgtcagccattttgcgcgcgcggatgaaccaaaatgtggcgcaaccgagaaacaactcgctatctttaataccttttgcgaaggcaaacctggtcaacgttccattgccgcgtcgggtggcattctgctgtggccacagtcgcattttgactgggtgcgcccgggcatcattctttatggcgtctcgccgctggaagatcgctccaccggtgccgattttggctgtcagccagtgatgtcactaacctccagcctgattgccgtgcgtgagcataaagccggagagcctgttggttatggtggaacctgggtaagcgaacgtgatacccgtcttggcgtagtcgcgatgggctatggcgatggttatccgcgcgccgcgccgtccggtacgccagtgctggtgaacggtcgcgaagtaccgattgtcgggcgcgtggcgatggatatgatctgcgtagacttaggtccacaggcgcaggacaaagccggggatccggtcattttatggggcgaaggtttgcccgtagaacgtatcgctgaaatgacgaaagtaagcgcttacgaacttattacgcgcctgacttcaagggtcgcgatgaaatacgtggattaatcgttctgtaatatttgattgtctgtgccggatgcggcgtgaatgccttatccggccaataaaatcctaaaaattcaataagttgatgttctttcatgctcttataaaggtcgtgcctctggcggatgtacgtttgtcatgagtctcactctgttgctaattgccgttcgctcctgaacatccactcgatcttcgccttcttccggtttattgtgttttaaccacctgcccgtaaacctggagaaccatcgcgtgtttcaaaaagttgacgcctacgctggcgacccgattcttacgcttatggagcgttttaaagaagaccctcgcagcgacaaagtgaatttaagtatcggtctgtactacaacgaagacggaattattccacaactgcaagccgtggcggaggcggaagcgcgcctgaatgcgcagcctcatggcgcttcgctttatttaccgatggaagggcttaactgctatcgccatgccattgcgccgctgctgtttggtgcggaccatccggtactgaaacaacagcgcgtagcaaccattcaaacccttggcggctccggggcattgaaagtgggcgcggatttcctgaaacgctacttcccggaatcaggcgtctgggtcagcgatcctacctgggaaaaccacgtagcaatattcgccggggctggattcgaagtgagtacttacccctggtatgacgaagcgactaacggcgtgcgctttaatgacctgttggcgacgctgaaaacattacctgcccgcagtattgtgttgctgcatccatgttgccacaacccaacgggtgccgatctcactaatgatcagtgggatgcggtgattgaaattctcaaagcccgcgagcttattccattcctcgatattgcctatcaaggatttggtgccggtatggaagaggatgcctacgctattcgcgccattgccagcgctggattacccgctctggtgagcaattcgttctcgaaaattttctccctttacggcgagcgcgtcggcggactttctgttatgtgtgaagatgccgaagccgctggccgcgtactggggcaattgaaagcaacagttcgccgcaactactccagcccgccgaattttggtgcgcaggtggtggctgcagtgctgaatgacgaggcattgaaagccagctggctggcggaagtagaagagatgcgtactcgcattctggcaatgcgtcaggaattggtgaaggtattaagcacagagatgccagaacgcaatttcgattatctgcttaatcagcgcggcatgttcagttataccggtttaagtgccgctcaggttgaccgactacgtgaagaatttggtgtctatctcatcgccagcggtcgcatgtgtgtcgccgggttaaatacggcaaatgtacaacgtgtggcaaaggcgtttgctgcggtgatgtaatgcaggaaagcaggctggagctacccagcctgcagtgaaattaaactgtcgtcgctttcactctttctttatagatgatttttttgatgccatcgttctacgtgagagataataaacgttgttagttcttttattgttaagcttatcccaattatctggaattccttatcctgtttttttgggtggagtaataatttctgcacatctaaccattattaaatttaataataagtatcgggtttgttacgatagaatatttctatatcctcaagaatatgctttgccttattgcctgtgactttctgagattcaattatagtatcgttaaattctaatgttaaagagaactcttttttccgctttgtgtaagtttaaccttatattgattaccaatatcaaataaaaaggtcctgtaatgagaataatcacctttaacctcctcggcaaaacagcaaagcgtgcaaatatacataaagtctttcttacccctgattttgttaactaaatcaataaatgcgtgaaaaactttacttgcaatagaacttgatacttcttctccaggtctaaaaaatcttttgcaatttttaactgtgtttctatgtataaaaagaaatctttggcataagagatatctttattatttagtgcatctagctcaacaggtaaagatgtcgttttgttgctattcacatatgatatattcatatcatcatctccatcgcgagtaataaaattaatcaccattgtagggtagggggctggtcaatcagaaatcatctttataaacttcgattgtttttgtaatgctgtatcattaagttcattaaatcgtacagcagataaatgttctatcaaatttcgctcatttgccgaggattcatcataataaacgtaaaattaatgtatccttacatcgagtaataaacattttttatacaaaaaaagacaggaacgtatttactgggttaaatataatcatcctgcttttcatcacaaaaaccgcagataatccttcctttccccggcagctggcgttatggtcagatggtttttgcaacaaatctcacaataaaaagtttcaacatactgactatttagggaaaaatatgcgcaagatcacacaggcaatcagtgccgtttgcttattgttcgctctaaacagttccgctgttgccctggcctcatctccttcaccgcttaaccctgggactaacgttgccaggcttgctgaacaggcacccattcattgggtttcggtcgcacaaattgaaaatagcctcgcagggcgtccgccaatggcggtggggtttgatatcgatgacacggtacttttttccagtccgggcttctggcgcggcaaaaaaaccttctcgccagaaagcgaagattatctgaaaaatcctgtgttctgggaaaaaatgaacaatggctgggatgaattcagcattccaaaagaggtcgctcgccagctgattgatatgcatgtacgccgcggtgacgcgatcttctttgtgactggtcgtagcccgacgaaaacagaaacggtttcaaaaacgctggcggataattttcatattcctgccaccaacatgaatccggtgatctttgcgggcgataaaccagggcaaaatacaaaatcgcaatggctgcaggataaaaatatccgaattttttatggcgattctgataatgatattaccgccgcacgcgatgtcggcgctcgtggtatccgcattctgcgcgcctccaactctacctacaaacccttgccacaagcgggtgcgtttggtgaagaggtgatcgtcaattcagaatactgacagagcgggagagcgtgatgctctcccgaatgctgtttttttaatcacacctttatcctttcgctgtcttgctgcaaactgattaagagagttttatcaaggagcagcacatgtggtatcaaaagacgctcacgcttagcgccaaatctcgtgggtttcatctggtaacggatgaaattctgaatcagctggctgatatgccgcgcgttaacatcggcttactgcatctgttgctgcaacatacctccgcctctctgacacttaatgagaactgcgatcccaccgtacgccacgacatggagcgttttttcctccgcaccgttcccgacaacggaaattatgagcatgactatgagggagcagacgatatgccttctcatatcaaatcctcaatgctgggaacatcgcttgtattgccggtgcataaagggcgtattcagaccggcacctggcaaggcatttggctgggggaacatcgcatccacggcggatcgcgtcgcatcatcgcgacactacaaggggagtaaaaaatgaccatttcggagttgctacaatattgcatggcaaaaccaggcgcagaacagagcgtgcataatgactggaaagcgacgcagatcaaagtggaagatgtactgtttgcgatggtgaaagaagtagaaaatcgcccagctgtttcgctgaaaaccagcccggagctggcggagctgctacgtcagcagcacagcgatgtgcgtccaagccgccatctgaataaagcgcactggagcaccgtgtatctcgacggttcgctgccagattcgcaaatctattatctggtggatgcgtcttatcagcaggcggtgaatttactgccggaagaaaaacgtaaattgctggtgcaactctgaaaggaaaaggccgctcagaaagcggccttaacgattacagcatcggcttaaggaagcgtgccgtgtgtgatgcttcgcactccgcgacggtttctggcgtaccggagacgaggatctcgccgccaccactgccgccttctggtcccaggtcgacaatccagtcagcggttttgatcacgtcgagattgtgctcaatcaccacaatggtgttgccctgatcgcgcagtttatgcagtacgtcgagcagttgctgaatatcggcgaagtgcagaccggtggtcggctcgtcgagaatatacagcgtctgcccggtgccgcgttttgacagttcacgcgccagcttcacgcgctgggcttcaccgcctgaaagggtggttgcggactgccccagtcgaatgtacgtcaggccaacgtccatcaacgtttgcagcttacgcgccagtgcaggtacggcatcaaagaactcacgcgcctcttcgatggtcatatccagcacttcgtggatggttttgcctttgtacttaatctccagcgtttcacggttatagcgtttacctttgcactggtcgcacggcacgtagatatccggcaggaagtgcatctccactttgatcacgccatcgccctgacaggcctcgcagcgtccgccacgaacgttaaagctgaaacgtcccggcgtatagccgcgcgcacgggattccggtacgcccgcaaacagttcgcgcacaggcgtaaacacgccggtataggtcgccgggttagaacgtggagtacgaccaattgggctttggtcgatatcgatcactttatcgaaatgctccagcccctgaatatcgcgatacggtgctggttcggcgatggtcgccccattcaactggcgttgggcaatcgggaacagtgtgtcgttaatcagcgtcgatttaccggaacctgaaaccccggtgatgcaggtaaacagacccaccggcagcgtcagcgtcacgtccttcaggttgttgccgcgtgcgcctgtcagcttcagcactttttccggattcgccggaacgcgtttcttcggcacttcaatcttgcgtttgccgctcatgtactgcccggtcaacgactccggcaccgccataatcgcttccagcggaccttctgcgaccacttcaccgccgtgaacacctgcgcccgggccaatgtcgatcacatggtcagcggcgcgaattgcgtcttcgtcgtgctccaccacaatcacggtattaccgagatcgcgcagatggataagcgtacccaacaggcgctcgttatcacgctggtgcaggccgatagacggctcgtccagcacgtacataacgccaaccaggcccgcaccaatctggctcgccagacggatacgctgtgcttcaccgccagaaagcgtttctgccgagcgggaaagcgtcaggtaattcaggccgacgttaacgaggaatttcagacgatcgccgatctctttaaggattttttctgcaatcttcgcccgctgacctgcgagtttgagattgttgaagaattccatcgcatgaccaatgctcatgtcggagatagcaggcagcggcgtattctcgacatacacgtggcgcgcttcccgacgcagacgcgtcccttcgcagctggcgcacggacgattactgataaacttggctaattcttcgcgtaccgcgctggattccgtctctttatagcggcgctccatattatgcagcacgccttcgaacggatgacgacgaatggaggtatcgccacgatcgttcatgtatttgaattcaatgttttctttgccagaaccgtacaacaccactttatgcacgttcgcgctcaggctgccccacggcgcttcgacgtcgaacttatagtgatctgccagcgatttcagcatctggaaataatagaagttgcggcgatcccagccacggatcgcaccaccagccagcgacagttccggattctggatcactcgatcaggatcgaaatattgctgtacgccaaggccgtcgcaggtcgggcaggcccccgccgggttgttaaacgaaaacagtcgcggctccagttcacgcatactgtagccgcaaattgggcaggcgaagttggcggagaacagcagctcttccgctttcgggtcgtccatatccgccactaccgcggtaccaccggaaagctccagcgcggtttcaaatgactcggcaagacgttgggtaagatcgtcacgcaccttgaagcgatcaaccaccacttcaatggtatgtttcttttgcagttccagttttggcggatcggaaagatcgcagacttcgccatcaatacgagcacggatgtagccctggcttgccaggttctccagcgttttggtgtgttcgcctttgcgctctttaatgattggcgcgagtagcatcagacgcttgccttccggctgcgacagcacgttatccaccatctggctgacggtttgcgccgccagcgggacgtcgtggtccggacagcgcggctcgccaacgcgggcgaataacaaacgcaaatagtcgtggatttcggtgattgtccccaccgtagaacgcgggttatgagacgtcgatttctgctcaattgagatggcaggagaaagcccctcaatatgatcgacgtccggcttttccatcagtgacagaaactgccgcgcgtaggcggaaagggattcaacgtaacggcgctgcccttcggcatataaggtgtcgaaagcgagcgaggatttgccagaacccgaaagcccggtcacgacaatgagcttgtcgcgggggataacgaggttgatgtttttgagattatgggtgcgggcgccccgaacttcgatcttatccattcacctttcccggattaaacgcttttttgcccggtggcatggtgctaccggcgatcacaaacggttaattatgacacaaattgacctgaatgaatatacagtattggaatgcattacccggagtgttgtgtaacaatgtctggccaggtttgtttcccggaaccgaggtcacaacatagtaaaagcgctattggtaatggtacaatcgcgcgtttacacttattcagaacgatttttttcaggagacacgaacatggccagcagaggcgtaaacaaggttattctcgttggtaatctgggtcaggacccggaagtacgctacatgccaaatggtggcgcagttgccaacattacgctggctacttccgaatcctggcgtgataaagcgaccggcgagatgaaagaacagactgaatggcaccgcgttgtgctgttcggcaaactggcagaagtggcgagcgaatatctgcgtaaaggttctcaggtttatatcgaaggtcagctgcgtacccgtaaatggaccgatcaatccggtcaggatcgctacaccacagaagtcgtggtgaacgttggcggcaccatgcagatgctgggtggtcgtcagggtggtggcgctccggcaggtggcaatatcggtggtggtcagccgcagggcggttggggtcagcctcagcagccgcagggtggcaatcagttcagcggcggcgcgcagtctcgcccgcagcagtccgctccggcagcgccgtctaacgagccgccgatggactttgatgatgacattccgttctgatttgtcattaaaacaataggttatattgttttaaggtggatgattaaagcatctgccagccataaaaaagaagcctccgttatggaggcttctacgtatcaggtcaaaatcattggccattgtggcggtgtctgattcatctcttctatcatcaccgactcgatgttgtgccagatagcggtgatgtccgccattgtgatgccaagcaaccccattgcgaaccaacaggcggaaacaacgcccagaccgctgctgatcaccgcaagcccgacataatcagaccgacgaaaacggatgttgagtgtgctggccagaaacatcattacggcactaagaagttgccagcgaagaagaaccacgccagtggtgagggtagccatcaaacaattcctctgaaaagagccgatgccctggacagcgcggcgttgttcacgggaggcgtggtacactctggctatcgcggggcttgcagaacacaaaaatgaaacactctgtttgtttcattaattttgtgaactatatcacaattgattgtttgttagccatattaggccgtgacttttattgctgtacagattatgtggtttttcagtggcattaagggcatatcttcccgccgcctctgcattcctgtaggaaattaattttgaatatcaatgaattattttcatccaggtgacgattagaaaggtatcaatttcaaatcaggcaaaagtgctatttataccgtaagatttatctaaagacgtcggtacccagggttttcaccttgcaatggccgggtataaacaggcaggaaattgatagcaatgagtcatcgtgcacgacaccaattactggcgttgccgggcattatctttttagttctctttcccatcattctttcgctatggattgccttcctttgggcaaaatcagaagtgaataatcagctccgaacctttgctcaactggcactggataaatccgagctggtcattcgccaggcagatttagtgagcgatgcagctgaacgctatcaggggcaagtttgcactccagcccatcaaaagcgaatgttgaatattattcgtggctatctttatattaatgaattgatctatgcccgtgataaccattttttatgctcatcgctgatagcgcctgtaaacggctatacgattgcaccggccgattataagcgtgaacctaacgtttctatctattattaccgcgatacgccttttttctctggctataaaatgacctatatgcagcggggaaattatgtggcggttatcaaccctctcttctggagtgaagtgatgtctgatgacccgacattgcaatggggtgtgtatgatacggtgacgaaaacctttttctcgttaagcaaagaggcctcggcagcaacgttttctccgctgattcatttgaaggatttaaccgtacaaagaaatggctatttatatgcgacagtttattcgacaaaacgcccaattgcagccattgttgcgacttcatatcaacgtcttataacccatttttataatcatcttatttttgcgttgcccgccggtattttggggagtcttgttctgctattactctggctacgtattcgacaaaactatttatctcccaaacgtaaattgcaacgcgccctcgaaaaacatcaactttgtctttattaccagccaataatcgatatcaaaacagaaaaatgtatcggcgctgaagcgttgttacgttggcctggtgagcaggggcaaataatgaatccggcagagtttattccgctggcagaaaaggaggggatgatagaacagataactgattatgttattgataatgtcttccgcgatctgggcgattacctggcaacacatgcagatcgctatgtttctattaacctgtcggcctccgattttcatacgtcacggttgatagcgcgaatcaatcagaaaacagagcaatacgcggtgcgtccgcagcaaattaaatttgaagtgactgagcatgcatttcttgatgttgacaaaatgacgccgattattctggctttccgccaggcaggttacgaagtggcaattgatgattttggtattggctactctaacttgcataaccttaaatcattgaatgtcgatattttgaaaatcgacaaatcgtttgttgaaacgctgaccacccacaaaaccagtcatttgattgcggaacacatcatcgagctggcgcacagcctggggttaaaaacgatcgctgaaggcgtcgaaactgaggagcaggttaactggctgcgcaaacgcggcgtgcgctattgccagggatggttctttgcgaaggcgatgccgccgcaggtgtttatgcaatggatggagcaattacccgcgcgggagttaacgcgcgggcaataaaattacaggcggtggcgataatcgctgggagtgcgatcaaactgccgacggaaaacgcgggagaaggtctgctgcgagacataacccaggtccattgcgatatcaaaaatcggacgctcggtggtgcgcaactcaacggcggccagtaacaggcggcgttggcgaatgtaatcgccaagcgtctgatgcgtcaccgtgcggaacattcgttgcaagtaccactttgaatagcctgatttttttgcgactacatcaatgttaagcggctggtcaatatgctcgtcaatccatgcgataagatcctgaataattttctgatgggacataaatctgcctcttttcagtgttcagttcgttaattcatctgttggggagtataattcctcaagttaacttgaggtaaagcgatttatggaaaagaaattaccccgcattaaagcgctgctaacccccggcgaagtggcgaaacgcagcggtgtggcggtatcggcgctgcatttctatgaaagtaaagggttgattaccagtatccgtaacagcggcaatcagcggcgatataaacgtgatgtgttgcgatatgttgcaattatcaaaattgctcagcgtattggcattccgctggcgaccattggtgaagcgtttggcgtgttgcccgaagggcatacgttaagtgcgaaagagtggaaacagctttcgtcccaatggcgagaagagttggatcggcgcattcataccttagtggcgctgcgtgacgaactggacggatgtattggttgtggctgcctttcgcgcagtgattgcccgttgcgtaacccgggcgaccgcttaggagaagaaggtaccggcgcacgcttgctggaagatgaacaaaactaaagcgccacaagggcgctttagtttgttttccggtctttgtctttctctctatcccgctggtacacaggagggtttcccccgacgtcaacacacctcattcgagcacgtggtggaggttccggttggtgttgatgctttaattgtatgtcaccgacgtttcttcgccagtgtaaaagtatactttttaaccgcaatatttttgtcatctcagacgattttttatcgcaatcctgaacggtatacggctcgataacgctgcaatcttgcgcaccgacgataacgtttgcgcatcaattgcctggtttttcatcgtcaagacaataaaagagaaaaaagcagcaaacttcggttgaaaaagccgctatgatcgccggataatcgtttgctttttttaccacccgttttgtatgcgcggagctaaacgtttgcttttttgcgacgcagcaaattgtcgcaaacctggagcaggaagataacgtttcgctggcaggggattgtccgccacgcatcttgacgaaaattaaactctcaggggatgttttcttatgtctacgccatcagcgcgtaccggcggttcactcgacgcctggtttaaaatttcacaacgtggaagcactgtccgtcaggaagtggttgccgggttaacaacgtttctggcgatggtctactcggtcatcgtcgttccaggtatgttgggtaaagcaggcttcccgcctgcggcagttttcgttgcaacctgtctggttgccggactcggttctatcgtgatgggtctgtgggctaatctgccgttggcgattggttgcgccatctccctgacagcgtttaccgcattcagcctggtgctggggcaacatattagcgtacctgtcgcgctgggtgccgtgttcctgatgggtgtgctgtttacggtaatttctgccacgggtatccgtagctggattttgcgcaacttgcctcacggtgtggcgcacggcacggggattggtatcggtctgttcctgctgctcattgccgctaacggtgtcggtctggtgattaaaaacccgcttgatggtctgcccgttgcgctgggtgatttcgcgaccttcccggtgattatgtcactggtaggtctggcggtgatcatcggcctggaaaaactgaaagtccctggtggcattctgctgaccattatcggtatctcaattgtcggtttgatcttcgatcctaacgtccatttctccggcgttttcgccatgccttcattgagcgatgaaaacggcaattcactgattggcagcctggacattatgggcgcgctgaatcctgtagtcctgccaagcgttctggcgctggtgatgacggcagtatttgatgccaccggaactatccgtgccgtcgccggccaggcgaacctgctggataaagatgggcagatcatcgacggtgggaaagcactgaccactgactccatgagcagcgttttctctggcctggtgggtgcggctccggcagcggtatacatcgagtctgcggcgggtacggcggcgggcggtaaaaccggtttgacggctatcaccgttggcgtgctgttcctcctgattctgttcctctctccgctctcttacctcgttccggggtatgcaacggctccggcgctgatgtacgttggcctgctgatgctgagcaacgtggcgaaaatcgactttgctgattttgttgatgcgatggcgggtctggttacggctgtattcatcgtgctgacctgtaacatcgtaacaggcatcatgatcggcttcgcgactctggtgattggtcgtctggtttccggcgaatggcgcaagttgaacatcggtacggtcgttatcgccgtggcgctggtgaccttctatgcgggtggctgggctatctaatctttcatcggattctgaaaacgggtggcaatggctgcccgtttttattttctccgcacattgtgtgagcttttgcgatattctgaaaaaaatgagaattcaggcataacgtctttctcagatcataaaaaacatcgcaaacagggaacgcatggaaatcttcttcaccatactgataatgaccctcgtggtctcgctgtccggggtggtcactcgtgtcatgccctttcagatcccgcttccgcttatgcaaatcgccatcggtgcgctactggcgtggccgacgtttggtttgcatgtggagtttgatcctgaactctttttagtcttgtttatcccgccgttgctgttcgctgatggctggaaaacgccgacccgtgaatttctcgaacatggtcgagagattttcggcctcgcgctggcgctggtggtggtcaccgtggtcggcattggcttccttatttactgggtggtgccgggcattccgctgatccctgcctttgcgctggcggcggtgctttctccgaccgatgctgtggcgctctccgggattgttggcgaagggcgcatcccgaaaaaaatcatgggcattttgcagggcgaagcgttgatgaatgacgcctccggtctggtgtcgttgaagtttgccgtagcagtggcgatggggacgatgatcttcaccgtcggcggtgcgacggtcgaatttatgaaagtagccattggcggtattctcgccggttttgtggtgagctggctgtacggtcgctcgctgcgattcctcagccgctggggcggtgatgaacccgcgacgcagatcgtcctgctgttcctgctgccattcgcttcttatctgattgccgaacatattggcgtttccggcatcctcgctgcggttgccgccgggatgaccatcacccgctccggtgtgatgcgccgtgcgccgctggcaatgcgcctgcgtgcaaacagcacctgggcgatgctggaatttgtctttaacggcatggtgttcctgctgttaggtctgcagctgccgggtattctggagacgtcgctgatggcagcagaaatcgaccctaacgtcgaaatctggatgctgtttaccaatattattctgatatatgcggcgctgatgctggtccgtttcggctggctgtggacgatgaaaaagttcagcaaccgcttcctgaagaagaagccgatggagtttggttcgtggaccacacgagaaatcctgatcgcgtctttcgccggggtgcgtggggcgatcactctggccggtgtgctctctatcccgctgctcttgccggatggtaacgtcttcccggcgcgctatgagctggtgttcctggcggctggcgtcattctcttctcgctgtttgtcggcgtggtgatgttgcctattctgctacaacacattgaagtcgcggatcattcgcaacaattgaaagaggaacgtattgcgcgagcggcaacggcagaagtggcgattgtggcgatccagaaaatggaggagcgtctggcggcggataccgaagagaatatcgataaccagctgcttacggaggtcagttctcgcgtcattggtaacctgcgtcgtcgcgccgatggacgtaacgacgttgaaagttccgtgcaggaagagaaccttgagcgtcgcttccgtctggcggcattgcgttctgaacgtgctgaactttaccacctgcgcgccacacgggagatcagcaacgaaacgctgcaaaaattactgcacgatctcgatttgcttgaagcgttgctaattgaggaaaatcagtaagccgaaagcgacgtaaccaggcccgaggtaatctgaaaaaggtgcaatcttttgcacctttaacaggttagctcgggctaacattcatgattctaaaacaaataaattatctctcttttaaagtcaattcattggctgttcttcgacttaacctcaatctgcatcttgcataatatctgcagtaatcttcatagcgactgcatgaagattatcctcagtttgtgacatgccagtatgagtggcacaatcttcttcaaagaatttctgtagtgttaccaggatatcactattaatggagatattttcctcaccacggagaatggtaatacccattccctggacgctagcctcatcgaaattaacacgatagagacggatattaaacatccaggcttttgttaaaacagaacagttgaaatggcaattgcttaaattggcattattaaaattaacattagccatattagagtcggtacatataaccatttcgaggaacgtatttgttaaccgcgtaaaaaagagtttgctatcaattaagtttatattctggagggttgctttattcaggttgacacgagacagatcagcatgttcaaagttaattaaatcaagtttagagaagctaaggtcggctctaaataaattaatatatggcgctattactttataaagatttacctcagccatgtatgccatataaaaatttgaataatcaaggaaggtatttttaatattggctctattcattgttgcattgtagaattgaacatgcatagcggaacatgaatttagagttccgtcagtcatttttatctgagcgaaatttgagtcatcgagaatacaattatcaaaaagtattttttccattatggcgaaattaaaattcgttttatacatattacagtcctgaaaaatagcgttttgtagtctgcaacctgcaaaattcgaattggataaatcttcatctttaatcacgatacctttcaggctaaggtgtgaaaaatcgtaaccaccatttactgtctgtgggatttcgatagtattattatggacggtgacattatttataaaatataccaccttaattgacacttccttatctttattaaggtaaactcttctcgtaattctatcgtcacatttattatttgcatgtgaagctatatctataaaatatttatgtattttcctgtccgtttctttcgtgatttttcctgatggtaaactatcataaattcttttcattttctgaatcaagcctatcactttttcatgatcatccattttgaaaagagagagggctttattgtcaattaacgtgtttttatgatgtttgctgtaattatctgattttgttttctttgtatgtgatggacttgtgacagagtggttatcgttaatcaggcaaagagggaaaaacatattatttaaaccattatagcgcataaaatatccttataattaacaagaaagaaaaggcatattctctgcattatcattttctacgactgtcaaaaatcgctcattttttaatgagtttatttgtttaatattatgggaaaaggtgatgcatttgggagaggaagagtattccccggtcagacgaccggggaaggggagagattaatgcgcgcggccttgctcaacgccaaagccggtctgggagcggataaactgcgcgcggaacagttcacgctcacgcgcgccttccgctgagttatcggttgccgagaagaaccagatgccgaggaatgccacggtgatagagaacagcgccgggtattcatacgggaagatggctttttcgtgaccaaggatctgtacccaaatcgtcgggccgaggatcatcagtactactgcggtaatcagccccagccagccacccatcatcgcgccacgcgtggtcagtttcgaccagtacatagaaagcagaatgatcgggaagttacagctcgccgcgatggcaaacgccagccccaccataaaggcgatgttctgattctcaaacagcacgccgaggataatcgcaatcacgccgaggatcagtacggtgatttttgatacccgcagctcttcacgttcggtcgcgccttttttgaagacgttagcgtacaagtcatgcgaaaccgcggatgcgcccgccagcgtcagacccgcaaccaccgcgaggatagtggcgaaagcaaccgctgaaataaaaccgaggaacaggttgccgcccactgcattcgccaggtgaacggccgccatgttgttaccaccaatcagatggcccgccgcgtctttatattccggattcgcaccaaccagcatgatcgcgccgaagccgataataaaggtcagaatatagaagtagcccataaacccggtggcgtagaacacgctcttacgtgcttcgcgggcatcgctgactgtaaagaagcgcatcagaatgtgcggcaagcccgccgtaccaaacatcagtcccagacccagagagagcgcggagatcggatctttcaccagcccgcccggcttcatgatgtcgacacctttcgggtgtaccgccatcgcttcactgaacagattgttgaagctaaagccgacgtgtttcatcaccataaaggccataaagctggcaccgaacagcaacagcacggctttgataatttgcacccaggtggtcgccagcatgccgccgaacaggacgtacatcatcatcagcacgccgaccagcaccaccgcaatgtgatagttaaggccaaacagcagctcgatcagtttacctgcgcccaccatctgggcgataaggtaaagcgccaccaccaccagagaaccacaggccgaaagaatacgaatcggcccttgtttcagacggtaagaggccacatcggcaaaggtgtagcgccccaggttacgcagacgttcggcaatcaggaacaaaatgatcggccagcccaccaggaagcccagcgagtaaattaagccgtcatagccggaggtaaacaccagcgcggagatccccaagaatgaggcggcggacatatagtccccggcaatcgccagcccgttctggaagccagtgatattgccgcctgcggtgtagtagtcgctacgagaacgtacgcgttttgatgcccagtaggtaatgccgagcgtaaacacgacgaaaatcaggaacataataatcgcctgccagttcgttggctggcgctctacggccccgctaatagcatccgcggcgttagctgcgaaagggagtgtggcggcaagcgccgtcagaactcttttcatgatgcttgtacctcatgcaggacttcattattaagacggtcgaattcgccgttcgcccgccagatgtagataccggtgagaacaaaggagatcacaatcactccaacaccaattggaataccgcgtgtgacgctggtgttcggattcagcggcgtgcccagccagccgggcgcgaaggcgatcagtaaaataaagccgatataaactgccagcataataatcgacaggatggtggcaaaccgttgccgtttttcgactaactccctgaaatgcgcattgtcttctatccgctgataaatagtgccattcatcacagattctccagaggtaatgtagggattgttttaattcccgctcccttatgggagaaggttaacgctcgggtaacccttgccgaatgtaggccggataaggcgtttacgccgcatccggcaatcaatgcctgatgcgacgctgtcgcgtcttatcaggcctacaaaccgttaccgactcgcatcgggcaattgtgggttacgatggcatcgcgatagcctgcttctcttcaagcagcttctcgactacgccaggatcggcaagcgtcgaggtatcgcccaggttgctggtatcgcccgccgcaattttgcgcagaatacggcgcataattttgccggagcgggttttaggcagggagtcggtccagtgcagcacgtctggcgtcgccagcgggccaatctctttacgcacccagttgcggacttctgcgtacagttctggtgacggttcctccccgtgattaagcgtgacgtaggcgtagatcgcctgacctttaatattgtgcggaatacctactacggcggcttcggcaatcttcggatgcgccaccagcgccgactcaatctctgccgtccccagacggtgaccggagacgttcagcacgtcgtccacacgcccggttatccagtaatagccatcttcatcgcgacgcgcgccgtcgccgctgaaatacatatttttgaaggtggagaagtaggtctgttcaaaacgttcgtgatcgccaaacagcgtacgcgcctgacccggccaggagtcggtgattaccaggctaccttcggtggccccctccagcgggttaccttcgttatcgaccagcgccggttgcacgccgaagaacggacgtgttgccgaaccggctttcagctcggtagcgccaggcagcggggtgatcatgaaaccgccggtttcggtctgccaccaggtatcgaccaccggacatttctcgttgccgatttttttccagtaccactcccacgcttccgggttaattggctcgcccacggaaccgagaatgcgcagcgacgaacggtcggtgccttcgatcgctttatcgccttccgccatcagcgcgcggatcgccgtgggtgcggtatagagaatattgacctgatgcttgtccaccacctgcgccatacgggcaggcgtcggccagttgggtacgccttcaaacatcagcgtggtcgcaccgcaggccagcgggccgtacagcaagtaactgtgtccggtcacccagcccacatcggcggtgcaccagtagatatcacccggatgataatcaaagacatatttaaaggtcagcgccgcgtacaccagataaccgccggtagtatgcagcacaccttttggcttaccggtagaaccggaggtgtagagaataaacagcggatcttcggcgttcatctcttccgcctggtgctgatcgctcgcttgctcaaccaggtcgtgccaccacaggtcgcgcccttcctgccagtcaattttcccgccagtacgcttcagtaccaccacatgctctacgctggtgacgttcgggtttttcagcgcgtcatcaacgtttttcttcagcggaatactgcgcccggcacgcacaccttcgtcggaagtgatcaccagtcgtgagttggaatcaataatgcgcccggcaacggcttccggcgagaagccgccgaaaatcaccgaatgcaccgcgccaatgcgggcgcaggccagcatcgcaaccgcggcttccggcaccatcggcatataaatcgccaccacatcaccttttttaatgcccagctcgagcagggtattggcgaagcggcagacgtcgcggtgcagctctttatagctgatatgtttgctctggctggcgtcgtcgccttcccagatgatggcggtacgatcgccgttttcttgcagatggcggtcaaggcagtttgccgccagattcagcgtgccgtcctcgtaccatttaatggacacattaccgggggcaaaggaggtgtttttcaccttctggtaaggtttgatccagtcaagaatttttccctgttcgccccagaaggtatcaggtacgttaatagattgttgatacatcgcctcgtactgctgagggtttatcaggcaacggtctgcgatgttggcaggaatggtgtgtttgtgaatttggctcatgcttttgttctccttgtaggatgttaataatatgtggcataagcgttaaatgtaggggtattggcagttttgtttagtatttgggcgacagatcacgcaaaagtagaattgtgcaaataaacggcagggtaatttttgaaggtcagcaacaaaagttgattaattctttgaggaacatgcagttatgcatgctgttgaaaaagaggaagatactgactaactctaaagtggtattttacatgcacttacaattgattaaagacaacattcacagtgtggttatttgttacacataggggcgagcaatgtcatgacagtgtaggtgcggttactgtcgtgaaaaacaataaaaaccgccattgcaacaatggcgcaattcggatgaagcccctatgacaaggataaaaataaacgcacgccgtatcttcagcttattgattccttttttctttttcacttctgttcacgctgaacaaacggctgctcccgcaaaacctgtaactgtggaagcgaagaatgaaacctttgccccgcagcatcccgatcaatatctctcctggaaagccacctcggaacagtcagagcgtgttgacgccctggcggaagatccacggctggtgatcctgtgggcggggtatcccttctcgcgcgattacaacaagccgcgtggacatgcttttgctgtgaccgatgtgcgtgaaaccctgcgtaccggtgcgccgaaaaacgctgaagatggtccgctaccgatggcatgctggagttgtaaaagcccggatgtggcgcgtctgatccagaaagacggcgaagatggctacttccacggtaaatgggcgcgcggcggtccggaaatcgtcaacaacttaggttgtgccgattgccataacaccgcctctccagagttcgccaaaggcaaaccggagttaaccctttcccgtccgtatgcggctcgcgcgatggaagccattggtaaaccttttgagaaagccggacgtttcgaccagcaatcgatggtttgcggtcagtgccatgtggagtattacttcgacggcaaaaacaaagcggttaaattcccgtgggatgacggcatgaaagtcgaaaatatggagcagtattacgacaaaattgccttctctgactggactaactccctgtcgaaaacgccaatgctgaaagcgcagcacccggaatatgaaacctggacagcgggcattcacggtaaaaacaacgtgacctgtatcgactgccatatgccaaaagtgcagaacgccgaaggcaaactctacaccgaccataaaattggtaatccgtttgataacttcgcccagacttgtgcgaactgccatacccaggacaaagctgccttgcaaaaagtggtcgcggaacgtaagcagtcgattaacgacctgaaaatcaaggttgaagatcaactggttcacgctcacttcgaagcgaaagcagcgctggatgcaggcgcgacggaagctgaaatgaagccaattcaggacgatatccgtcatgcccagtggcgctgggatctggcgatcgcttcccacggcattcatatgcacgcaccggaagaaggtttacggatgctcggtacggcgatggataaagcggcggatgcacgcaccaaactggcgcgcctgctggcgaccaaaggcatcacccatgaaatccagatcccggatatctcaaccaaagagaaagcccagcaggccattggcctgaacatggaacaaatcaaggccgagaagcaggacttcatcaaaacggtgatcccgcagtgggaagaacaggcacgtaaaaacggtctgttaagccaataaccccgttccgcctcgcaaggggcggaaaacacaatggagtgaatatgagcgtattacgttcgttattaactgccggggtgctggcgtcgggcctgttgtggagcctgaacggaattaccgctacccctgcggcgcaggcatctgatgatcgctacgaagttacccagcagcgtaacccggatgccgcctgtctggactgtcataaaccagataccgaaggtatgcatggaaaacatgcttccgttatcaacccgaataacaaactgccggtcacctgcaccaactgtcacggccagccatcaccgcaacaccgcgaaggggtgaaagatgtgatgcgctttaacgagccgatgtacaaggttggagagcagaacagcgtctgtatgtcctgtcatctgccggaacagttgcaaaaagcgttctggccgcacgatgtccacgtaaccaaagtggcgtgcgccagctgccattccctgcatccacagcaagatacgatgcagacgttaagtgacaaaggacggattaagatttgcgtcgattgccacagcgatcagcgcaccaatccgaactttaacccggcgtctgttccgttgcttaaggagcagccatgacctggtctcgtcgccagtttctcaccggcgtcggcgtgctggcagccgtcagcggcaccgcagggcgcgtggtggcgaaaacgttgaatatcaatggggtgcgttacggcatggtgcatgacgagtcgttatgcatcggctgtaccgcctgtatggatgcttgtcgggaagtgaacaaggtgccggaaggcgtctcgcgcctgacgattattcgtagcgagccgcagggcgaatttcctgatgtgaaatatcgcttcttccgtaagtcttgccagcactgcgatcatgcgccgtgcgttgacgtctgcccgaccggtgcgtcttttcgcgatgctgccagtgggattgtcgatgttaatccggatctctgcgtcggttgtcagtactgcatcgccgcctgtccgtaccgcgtgcgctttatccatccggtcacgaagacggcggacaaatgcgatttctgccgtaagaccaatttgcaggccggtaagttgcccgcgtgcgttgaagcttgcccgaccaaggcgctgacgtttggcaatctggacgatcccaacagtgagatttcgcaactgctgcgccagaagcccacttaccgctacaagctggcgctgggaaccaaaccgaagctgtaccgcgtaccgtttaaatacggggaggtgagccaatgacgcagacttccgcatttcattttgaatcgctggtgtgggactggccgattgccatctacctgtttttgattggtatttctgctggtctggtgacgctggccgtgctgttacgtcgcttctacccgcaggcgggcggtgcagacagtacgttgctgcgcaccacgctgattgtcgggccgggcgcggtgatcctcggtctgttgatcctcgtcttccacctgacaagaccgtggaccttctggaagctgatgttccactacagttttacctcggtgatgtcgatgggggtgatgctgtttcagctctacatggtggtgctggtgctgtggctggcgaaaatctttgaacatgatttgcttgccctgcaacaacgctggttgccgaagctggggatcgtgcaaaaggttctgagcctgctgacgcccgttcatcgcggactggaaacattgatgctggtgctggcggtgttgttgggggcttataccggctttctgctgtcggcgctgaaatcgtatccgttcctcaataacccgatcctgccggtgctgttcctcttctccggcatctcgtccggtgcggcggtggcgctgatcgccatggcgatacgccaacgcagtaacccgcattccacggaagcgcagtttgtacaccgtatggaaatccctgtggtatggggtgaaatcttcctgctggtggcgttttttgtcggtctggcgctgggcgatgacggtaaagttcgtgcgctggtggcggcattaggtggcggtttctggacgtggtggttctggcttggtgtcgccgggctggggctgattgtgccaatgctgctcaaaccgtgggtcaatcgcagttccggcattcctgccgtgctggcggcgtgtggggccagtctggtcggcgtgttgatgctgcgctttttcattctctacgccggacagttgacggtggcgtaagccagaaaagaggtggtttctggacgtattccttcctgaagtcggttttctggcgttgttgttaagtctcggggtcaacgtgttgaccccgttgacggccttcgcgggagtgcggttgcgctggcctgccatgatgcgactcacttgcatcggcattctggcgcagttcgcgctcctgctgctcgcctttggcgtactgacgtattgttttctcatcagcgatttctcggtcatttatgtcgcgcaacatagctatagcctgctgtcgtgggaactcaagctggcagcggtgtggggcggccatgaaggttcgctgctgctttgggtgctgctgctttccgcctggagcgcgctgtttgcctggcattatcggcagcaaaccgatccgctatttccgctgacgttagccgttttatctctcatgctcgccgcactgctactgtttgtggtgctgtggtccgatcccttcgtgcggatatttccaccagcaatcgaaggccgcgatctcaatccgatgctgcaacatcccggtcttatctttcatccaccgctgctttaccttggctatggcggtttgatggtagcggcgagcgtggcgctggcgagtctactgcgcggcgagtttgatggtgcctgcgcccgaatttgctggcgctgggcgttacctggctggagtgcattaacggcggggatcatcctcggttcctggtgggcctactgcgaactcggctggggcggctggtggttctgggatccggtggaaaacgcctctttattaccctggctttctgccactgcgctgctgcacagtttgtccctgacacgccagcgggggattttttgccactggtcgctgttgctggcgatagttactctgatgctgtcgctgctgggcaccttaattgtccgttctggcattctggtttcggttcatgcgttcgcgctggataacgtccgcgccgtgccgttgttcagcctgtttgcactgattagccttgcgtctctggctctgtatggctggcgagcgcgggacggtggcccggcggtgcatttttcggggttatcgcgggaaatgttaatcctcgctacgctgttgctgttttgcgcagtgctactgatcgtgctggtgggaacgctttatccgatgatttacggcctgctgggctggggacgcctctccgttggcgcgccgtattttaaccgcgcgacgttaccgtttggtctgttgatgctggtggtgattgtgctggcgacgtttgtctctggcaaacgcgtgcagcttccggcgctggtagctcatgcgggcgtgctgttatttgccgctggggtcgtggtctccagcgtcagccgtcaggagatcagcctgaatttacagccgggtcagcaggtgacgctggcaggatacaccttccgttttgagtgcctcgatctacaagccaaaggcaattacaccagcgaaaaagcgatagtggcactgtttgaccatcagcaacgcattggtgaactgacgccggagcggcgtttttatgaagcacgccgtcaacaaatgatggaaccgtcaattcgctggaacggcatccatgactggtatgcggtcatgggggagaaaactgggccggatcgttacgcttttcgtttgtatgtacaaagcggtgtgcgctggatctgggggggaggattgttgatgattgcgggcgcattgttaagcggatggcgggggaagaagcgcgatgaataaagggcttctcacgctactgctgttatttacctgttttgcgcacgctcaggtcgtagacacctggcaattcgccaatccgcaacaacagcaacaggcgttaaatattgccagccagttacgttgtccgcagtgccagaatcaaaacttactggaatccaacgcgccggtggctgtcagtatgcgccatcaggtttacagcatggtggcggaggggaagaacgaagtcgaaatcattggctggatgaccgaacgctacggagattttgttcgctataacccaccgttaacgggtcagacgctggtgttatgggcgctgccagtggtgttgttactgctgatggcactgatcctctggcgagtgagggcgaagcgatgaaacagcccaaaataccggtgaaaatgctgacaacactcacgatattgatggtatttctctgtgtcggcagttatctgttaagcccaaaatggcaggcggtacgtgcggagtatcagcgtcagcgcgatccgctacatcagtttgccagccagcaaaccccggaagcgcagcttcaggcattgcaggataaaatccgcgctaatccacaaaacagcgaacagtgggcgttactgggcgagtactatctgtggcaaaacgattacagcaattcgttgctggcgtaccgtcaggcgttgcaactacgtggtgagaacgctgaactgtatgcggcgctggcgacggtgctttattaccaggccagccagcatatgaccgcccagactcgcgcaatgatcgacaaagccctcgcgctggacagtaatgaaatcaccgccctgatgctgctggcttccgatgcgtttatgcaggcgaactacgcgcaagccatcgaactatggcaaaaagtgatggatctcaactcaccgcgagttaaccgaacacagctggttgagtcgattaatatggcgaaattgttgcagcggagattggattaatcatctggtgatgaagattatgtcattgagctgcataaaaaataatcgaatgaacatatgccaaaaataatcactaatcagtattattgcagattaaacaaataaaaatctttccataacaaatggttattcattaatcctgccataaactcgcgttattatgcattaatgcagcgaaaagctctgttgttaaagggttgcgcaacataccgcgcaaatgatactgatcataagcgttaaaaaaatctacaaaccaacgcaacacaattcatgccctggcagtatgtcacgttctcgcgtttctgaacggggaacggcgctccattgaggaagtcattcatatgaaaaatataaaattcagcctggcctggcagattctgtttgctatggtgctgggcattctcctgggaagctacctgcactaccatagcgacagccgcgactggctggtcgtcaatttgctctctccggcgggtgatatcttcatccatctgattaaaatgattgttgtgccgattgtgatctccacgctggtggtgggtatcgcgggtgttggtgatgccaaacagctcgggcgtattggcgcgaaaaccattatctacttcgaggtgatcaccaccgtcgccatcattttggggatcactctggcgaacgtcttccagcccggtgccggggtggatatgtcgcagttggcgaccgtcgatatctcgaaatatcagagcactacggaagcggtacaaagcagttcccacggcattatgggcacgattttgtcgctggtgccgacgaacattgtggcgtcgatggcgaaaggcgaaatgctgccgatcatctttttctcggtgctgtttggtctggggctttcttccctgcccgcgacgcatcgtgaaccgctggtgaccgtgttccgctccatctctgaaaccatgtttaaagtgactcacatggtgatgcgttatgcaccggtgggtgtgtttgcgctgattgcggtgacggtggctaactttggtttctcgtctctgtggccactggcgaaactggtgctgctggtgcatttcgccattctgttcttcgcgctggtagtgctgggaattgtggcgcgcctgtgcgggttaagcgtctggatcctgattcgtattctgaaagatgagctgattctggcgtactccactgccagctctgaaagcgtgctgccgcgaattattgagaagatggaagcctacggagcaccggtgtcgatcaccagtttcgtggtgccgaccggttactcttttaaccttgatggttcgacgctgtatcaaagtattgccgctatcttcatcgcgcagttgtatggcattgacctgtccatctggcaggaaatcattctggtgctgacgctgatggtgacctcgaaagggattgctggcgtgcctggcgtgtcgtttgtggtgttgctggcaacgctgggtagcgtaggtattccgctggaaggtctggcgtttattgctggtgttgaccgtatcctcgacatggcgcgtactgcgctgaacgtggtgggtaatgcgctggcggtgctggtgattgccaagtgggaacacaaatttgaccgtaagaaagcgctggcttatgagcgtgaagtgctgggcaaatttgataaaactgcggatcaataattgaagattgccggggatatccacccggcaatgtgtgaatgcctgatgcgacgcttgccgcgtcttatcaggcctacgccagacagcgcaatagcctgatttagcgtgattttgtaggtcggataaggcgtttatgccgcatccgacatcaacgcctgatgcgacgcttaacgcgtcttatcaggcctacgccagacagcgcaatagcctgatttagcgtgattttgtaggtcggataaggcgtttacgccgcatccgacatcaacgcctgatgcgacgcttgccgcgtcttatcaggcctacgccagacagcgcaatagcctgatttagcgtgattttgtaggtcggataaggcgtttatgccgcatccgacatcaacgcctgatgcgacgcttaacgcgtcttatcaggcctacgccagacagcgcaatagcctgatttagcgtgattttgtaggtcggataaggcgtttatgccgcatccgacatcaacgcctgatgcgacgcttaacgcgtcttatcaggcctacgccagacagcgcaatagcctgatttagcgtgattttgtaggtcggataaggcgtttaccgcatccgacatcaatgcctgatgcgacgcttgccgcgtcttatcaggcctatcttaaccgttggttaatttttcaaactcttcacacccggtatcaaacccttccatacagctcaggttcaaccagtgcagcgccttttgcttgttcttctcgataaaaccttcttcaccgtttaagaacatcattcccgcccagtactcggaataaccggttcgggaaattgcagagctgcgtttgaaataccaggttgccttgtcatcgtcggccttaatgcccacgccgttggcgtaaatcaaaccaagcagcatttgggcatcgacggcagagtcgttctccagatcttccgaggcgttttctaacagcgaaattgcctttggataatccggtttacccgcttgagtatttaccagaatatgcgccagcgttacttcaccttctttactgcccgcttgcgccgctttctctgcaagaacttttgcttgtggatagtccagactgaccggattggtgattttgatctgcgccagcagcgcgcaggcatcagcatcaccgctgtcggcggctttctgtgcccaatattcggctttgctcaaatcgccggagctaaaccagctgtcggcaagaaaatattgtgcgcgtcggtccccggcctctgctgcctttaaatactggctgccaggctcggagtcgttggcgtgggcaaagaatgtcaaaaacaacatcaatgcgataatttttttcattttgataatacgattgggtagggagtaaccagtataaagagttcgaatggataaaaaaacagcctccgaaaggaggctgtagaaaggacggtattacgccagtgccgcttcgcgcaggcgagttttcaacttgttgtactcgtcaatcacgtactgctcggcggcgcgctgatcggcgatcggctcgacgcgaacggcgcagtatttgtactccggcgttttcgtaatcgggcttaagttttcggtaaccagctcgttacaggcaccaatccaccactggtaggtcatgtaaatcgcccctttgttcggacgatcgctgacctgcgcacgggtgataattttgcctttacgcgagtgcacccaaaccaatgcctcatcttcaatacccagacgtttggcgtcttcggtattgatttgtgcgtagccaggttcatcagccagcgccgccagtgccgcacagttaccggtcatcgaacggcaagagtagtgaccaacttcacgcaccgttgacagtaccatcgggtactcgtcggtgagtttgtcgattggcgctacccagtcgcaggtgaagaactgcgccagaccgttcggggtatcaaacttctctttaaacagataagaagtcccctgatcggcatctgaagtatcgcggcaaggccactgaatgaagcccagttcgcccattttctcgtaagtcgcaccgtagaaatccgggcacagatgacgcaactcatcccagatctcctgggtgttgttgtagtgcatcggataacccatacgggtggcgatttcactgatgatttgccagtccgttttcagatcccatttcggttcaaccgccttgaagaaacgctggaagccacggtcagccgcagtaaacacgccttcatgctcgccccacgacgttgacggtaaaataacatccgccgccgacgcggttttggtcataaagatgtcctgaacgataaccagttccagatcttcaaaggctttacgtactgccgacagctccgcgtcagtttgtagcggatcttcgcccataatgtacgcggcacgcacttcgccatgcgctgcgcggtgcggcagctcgctgatgcgatagccggtatgcgctggcaggctttccacgccccaggctttggcgaatttctcgcggttagccggatctttcacgtactggtatcccggatacgtatccggcagcgcgcccatatcgcaggcaccctgaacgttgttctgaccacgaaccgggttaacacccgcatgcggcttaccgaggttaccggtcagcatcgcgaggctggtcagagaacgcacggtttccacgccctggtagaactgggttacacccatgccccacaggatggcggcgcttttcgcctgggcatacatccgtgccgcctgacgaatctcactggcgctgacgccggtgatatcttcaaccgactccggcgtgtagccttcaacgattttacgatactcttcaaagccttctgtacgtgaagcgacgaacgctttgtcgtacagattttcttcaataatgacatggcccatcgcattcaacagcgcgatgttcgagccgtttttcagtgcaatgtgcatgtcagcaatgcgcgcggtttcaattttgcgcggatcgcagacgataattttcgccccgttacgtttagcgttaattacgtgattcgccacgattgggtgggaatccgccgggttgtacccgaaaacgaacactaaatcggtattatcaatttcgttaatagcattgctcattgcgccattaccgaccgattggtgcagacctgcaaccgatgggccgtgtcagacacgagcgcagcagtcaacgttattggtaccaataacggcgcgcgcaaatttttgcattacatagttggtttcgttacccgtaccacgcgaggagccggtcgtctggatggcatccggaccgtacttctctttgatggcgctcaggcgctcggcaacgtaattcagtgcctcatcccaggaaacaggttcgagtttgccgccacgctggcgacggatcatgggggttttcaggcgcggggtcaggatctgggtatcgttaatgaagtcccagccataataacccttcagacacagggtaccctggttggttttcccctgcgctgcctccgcccggacgattttgccgttatcgacgaccaggttgattttgcaacctgatgcgcaataggggcaaaccgtgacgacttttttcatcggtctcgctccagttaatcaaatcacgcatacgcgctctcgactacagtatgcatcttttatgccacattttatgtggggtcattccctgatattacgggcactatttattcaaaactctgacgaaaaacaggctgtcgtcagttttgacgtgacgaaacgaaataccgcgtgacagccatcacgcggcagacattttattttttctcgacgacgggacctgcctgatacccgccgcccagcgatttcatcaactgaatgctttggatcacccggcggctgtccagcatcagtaatgacatctcttcggcaagcactggcaaccgggcttcggtggcctgtaagcggctggttaagccgcgctgataggcggcctcggcagcgcgctgggtaaagcgcgtggcttccacgcgttcagcctgcatttctcgctcgtcgttgagcgtttgcagacgcgtgccgttgacggcaacgtcacgcaccgcgttcagtactgactggttgtaacgttcaatcatcatgttgctggcggcgcgcgtgccttcgagattggcattcaaccgtccaccgtcaaacagcggcaatttcagacccgggatgaagttgaactggcgactggtttttttgaataaggtatgcagatggatggagtccagaccgaaaaacgctttgatatcaaagctcggatagaacaacgcccgcgcggaatccacctgatctaatgacgcctgaacataccagcgcatggcttgcagatccgggcgtctggcgagcaactcataagagagtgtcgccggaatgccggtctggacttgcggtaatgccaccggtctgatctccggcatatcgctggctcccgcgccaatcaatgcacgcagagattctcgcgtttcggtgatttgccctttgacggcaacaatttgtttatcgaccgccagaatctgtgcccgcgcgccgtggaaaggcacttgcgcttccagaccgtgcgccactttactctggtgcgctttcaccgcgtaatcaatcacatcgtgagtttgttctaacagatcgagcatctgatagctggcctgcatactgtaataaagctgcgctacgcccgtggccagcgatagctctactgctgcggtttctgccagcgcggcattatgcgcgccaatggcggcggcaaccgctgagcgatgcacaccccacaaatcaagatccagtccggcaaacaaacctactgtggcttccgtatagtacggcccgtccatacccagtgctggcgcatccattgaataagggcttaaaaagccgttcgccgagacacgttggcggttgagcatccctaacgctgcgacctgtaattgtgaaccggcatctaacaaatcggcctgggactgcgctttttcttcccgcagtttcgcttcggcgagggtgtgtgaaccacttagcgtccgttggatcagcgcatccagctgcgggtcattgagttgtttccaccactgcgcctgcggccagccggagctggcaagatgaatatcgtcggccagtttgatttgttccggtttgagctgttgatgaggtgcagaatccttacgtaccagggcacagccggaaatcagcgtcgtgctgccgagaatgctgcacaacagcagacgtgaaagttgacgattgatcattgcgtggctccttgtgcctgttccgtggcgggcgttaatgccggggctgtccagtctggcaagcgggcgaaaagctggcagacgtgttgctcctgttttaataaggtgggcaggatggcctgagaggcgggtgtctcttcaagcgttatttgaggagaacggctgagtgcggttgccagaccggcagcgtatttctccagggcgtcggcaaactgacctgctctgtccggctgtagtgcgttatccagcgcctgcgccgagttccaggtggcatcccaggcgtgaagaagatcgcggccctgacgaataaccgtttgcgaacgttcaatcagtaatgcgcgttcttcgctgtccagttgacgctccagcgccacgcgttggcacatctcttcacaggcattaaacgccgcatgcagaccgatacgaatttgcagataagtgcgcagagccgtgacttcctgctggcgtgggatccgcattactttacttaacatacccagcgtgccagccagtttttgcggcagtgtgcgcgcttcactttcaggccagacaaaggtgtaaatcaccgcggacaccacggtaccaatgatgatacccagggcgcgatcgcgaatttccaccaggtcgtacactgggccaaaaacgttttcgagcgtggcgagcgcgaaggtgaccaccatctgtgtgccgatataagaagagcgttcagagctggtggcaatccatgcgcccaacaggaaaatcggtgccagcacaaacagcaattcgacaatattgtccagccagggcatgaccagtagcgtgaataacagcgccagaatcgcgccgcaaaaggccccgccaaaacgcagcaccatcttctggtacgacgaaccgacatttgggttagcgacgatcacgcatgtcagcatacaggtgtgaatgccttcccagtccacgccgctgtaaaaggtgtaacagatcaaacaggcgagcagcgtttttaccgcgtagcgcatatagtctggattggtaaaagcatcggcggccattgatggcggtttggctgcgggcgttggcggcgtattcgggtccatctgacccagttgtaacaacgtctggcagatattctccaggttacattcccgtgccgccatcgcttcactttcactgatccgccagtcgctttgccagcactgaccttcagcaacggcatgctgcagcttgttgatttctgaagctaatttttgtcggaattcaataattgcctgagaatcagcaaaagaggtgggatcgtagcgattcagcgtcgagtaaatgtaggttaccgttgccacgcagctttgccaccatgcgttttgagttcgccagttggcatcgtccgcgaggcaaaagacattgagtttttgtagcgccagcgcctctctttcaatccgcgtttcgggtagcggtgcgaggctgtctgtcaggtgactaatggcatcatcaagccgatcattaagcgcctgatgcatttgcgaaatggcacgactgggaaaccacagcacgccgattaacgtcatcagcaaggttggatagaggccaacaacgatacaccacagcgttaagcgcacgaccacttccggatagtcgagcatggcggggaaggtttgcccgtaaatagcgacaatggcgacggcgaaaaagaccagccccaagcgatgggtgcgcatcaaaaacatgcagcccatcaggatcggtccggcgatgatcaatcggatcaacggttcgccgtatgaccatttgtagatcaaaaacaggctgccgatctccagcaccgtggcaaccacaaacaagatcgcgacaaatttggtgtaaaacgcgttcgactgaataccgtaaaacagcactgccagcgataacgccacaaaagggatctcaaaggtcatcgagatcagaatcaccagcaggcagcctacccagagttgcacggtctgcggcacgcgacctggtcgccgctcgcttaactcttcatgaaagaacgccagcagcctgaccaccggtaatggcagggagttgagcgcgctcattattgcggctcaagattagcgactgccgaagcgccgatgcggaacatttccgggtcaggtttatcgaccatgattttgaccggaaaacgctgggcaacgcggacccagttaatagaacgagacactttcggcaggccgcccagcaccaggccgccgtcatccggtagcacgccgtagccaatcgaatccactttaccctcgaaggttttgccgctgtcactcatcaggcgaatcgttgcgggtgtacctgagcgaatatttttcagatcggtttcgcggaagttggcgatcacataccagtgacgagtgtcgattagggtaaaaatagggcgcatggcagaagcaaattgcccgacggaggttttgagggaaatgacccggccatcaaacggcgcgcgaacggtcgccatttccagatgcagtttggtcagggcaatatccgcttcgaccgccgcacgctgggcaactaatgcatccacgccgctgacggcgctggcggctgactgcgcctgtaacaatacggcattaagatccgcttctgcggcgcgctgcgccgttcttgcacggtcaacatcttccgctgagacaaaaccttctttcagtaatggctcggtgcggcgtaatgtatctgtggcctgtttcgcggcggcacgggctttttctaccgtggcattaaccgagtcggcaccaaactgttgcgcgtcaacgctacgctgggtgagcataatttgcttatccagcgccgcgagggaggcttcagctttcgccagattggcttcgtacgggcgcgggtcgatgcggaacagcaaatcgccctgtttgactgcctggttgtcggtgaccgccagttctacaatgcggccgctgacttccggtaccacatcaatggtatctgctgacgcgtaagcgtcattagttgatggcgcactgtctacgcgccagataacgaaaacaagggcaaccagcgccaacgcaaccactaacagagcagggaatttactgcgaggagcttttttcggcgtactttccatgagcgcgtctcaaatagattagaaaaatgccagccagaacagcatggcgtagagagcaaaaagggcggtataaataattccgacaaatgccagattgatatttgcccgctgaataactcgcctcgtgatgagcgtcaaaataaggctggcaatggcgcagaaaaaccagctgggataataagcgccgatcaccgggattgccggagataatgagcatcccgaaaccatgaagacgggaattatccaggctgtttttttgagttgcatcgccatgcgagagagaactgttggcatattaaatacatcctgtctgctgcgaacaatatctgtagtgaatatcaatatccattgaaggcgtcagtatggctattttcttgatgaataaaaatagctttattcagccaccgcattcataacttatatattttatttattaattggctgtatatatttttaaaataaatacttttgggggcttcagcgcccccaaaagcgagtgacattaatttggggttacgatattcacccacaaatcgaaattatccagacaggcgataatttcttccagtttcgcgccattgccaataattttggctttcttcgcttttaccagatccgccattttggcttgtccggtcagcacggcgtgcagatcttcacggctgatgtagaaagaggcgtcggcttgcggttgcagcgttttccggtagttaagcacgctatcgttcagcgtcaggttgaggttatcgccgttgctcatattgaagttcaggctgatatttttacccgcagctttcgcgctatcgaggcgaacggccataaagtcgaacagcatttcgaccgacatcccgcgaatggtgtccggggaaccggtggtgccgtggctgaacttatgcaccccttcgcgcagctctttcgcgccggtcaggtagaaaccgcgccatgtggcggactcggcctgatagcccagctgttcaaagttattcgcttgcagattcttcgcgacctggtcacccgggttggcggcaatcacctgtttcagcagttctgccgaccagcggtaatcaccttgcttgttcgcttcttgcgccaggttgatgacacgggcagaaccgcccagcgcctgcacgtaacgtttacccatctccacctgaccatacggatgcaggttagccgggttaccgtcgtaatagccaagatagaagttatacaccgcgcgggcgttgtggctgacagaaccgtaatagccgcggctggcccagttattggcaagtgcaggcggcagcttaatcatgtcgccgatttcattcatggtgtagccctggttcgccaggtgcagggtctggtcgtgaatgtacttgatggtatcgcggtatttaccaatataatcattgatatgcttattgccccagaccggccaggtgtgcggcataaacagcacttccgcgtcgttaccccacatatccagcgtttcgttcagatactcggtccacttgctggtgtcgcgggttttcgcgccgcgcagagtgtagaagttgtgcagggtatgcgtggcgttctcggcggtacacagggctttcagggccggaatatagaagtgcatttcggctggcgcttcgctacctggggtcatcaggaagtcaaactccaggccgtcgataatcatcttctcgccagttctgacgatagttttcgtcggtgcaataatgctcgggtcgcccgttgccagcgtcacgccaaggccattacccacattgccttgcgcgttgtgcggcagtaacagaccgtaagagtagagcgcacggcggctcatgatgttacccgccagcacgttttcgctgatggcttcgtccataaagcctgcaggggcaatcacctgaactttgccggatttaacatcggcttcagagataatgcctttcacgccaccatagtggtcggtgtggctgtgagtgtagataacggcaacaatcggtttttgcggacgatgctggaagtaaaggtcaagtgcggcttttgcggcaggcggcgtcaccagcgggtcgataacaataatgcctttctcgccctcaacgaacgtaatgttagagatatcctggccgcgcacctgatacattttatcggtgactttgaacaggccagaaataccgttgatttgcgactgacgccacaggctggggtttacggtttccggcgctgcggcattaatatcaaatttgtaatcgtccgcgcggtagtaaactttaccgttcgcatcacgcagaataccttcatccagcagcggggcgataaatccacgctgggcatcgtcaaaatcctgacgatcgctaaacggtaatgatttggcgtaattctgattaacctgttgggtatattgagtggcggctttcgcttcctctttcgcgttagcggtatttaccatcatgccgctggcggcagttaacgcaataacaatcctgctcaaacggaataaccgagagttattcatataaatctccatttatcatttatgtcgtaaatatgtaatccatgcaaaatacgtcatttaaagctggcgttatcataattgggaaattgcgactttaataagtggaagtgtgagcggaacgcgccattttattaggcatttgtgctgaagagggaaaattacagtaaaactatcattgcagaaaataatatgagtcgttttatgtgtttattatatatattgtacctgtcgttggcacagcgggacattgcgctactgtgccaacgttttactcatggggctttagcacagaactgtggcaaaaaacgttgatgcgccaatattgctgcaccctgagcgccattaaagtcagaagatgaggcggcaataaagcgcacgacctgatgcggcagtggacggcgcaggtacttttgggtcatggcaacgagagtctcgcgtgggaaggcgggcatatccatcacgccaccgcccaggatcaccgcatcgggatcgaacagattaatgctggtggcaatggcccgtgccgcgttttcaagcagactctggacgaaaggggcgttttccgcatggacgaaaagatcgcgcaatgggtaatttcggggctgttgttcgtaccagcgtcttagcgccattccagagcaattggtttccaggcacccaggattgccacacgcgcagtgttgggtcatatctcccagggggatatgacccagttcgcctgccacaccgtgtgcacccgtccacggcgcaccgttcatccacactgcgaaccccatccccgtaccgagataggccgccagaaccagttgttgcgtaaggcggttttctactacgtcccaggagagttgcaggttaacgtcgcgggaaaactcaaccggacaattcagcgtattttcgagcttatcggcgagatcatataaatccgccgctgttaacggcaggttaggcgtagaaataatggtgcgtttatctttactgaccagcgccggaaatcccatcaccagaccatgacagcgagcgttaaagcgcctgagttgctcgtcaatcatttcgccgatacccgacaccaggccgggagcaatgacttctgcggtccgctttttttcgcagtgtagcgtttcaccttctgctgtccgcagacaaaagcggatatgcgttgcccccatatccacgcccgctacgacgttatgctgtttttgcatgaggctgtacctcgctttttgcagccagaatctgcgcggtcataattctccatgcttcgtcgatattttccgcatgattaaacaggccggaagtgccgacgataaagacatccgcccctgccgccatcagtttttcgtaagttgcctggttgcaggaaccgtccacctcaatttcgtactccagaccttctcgttcacgccatgccttcagttcggcaagtttatccagcatttcaggaatgaacggttgtccggcaaagccgggatcgacagtcatgaccgtaattttatcggccttatggatatagtatttcatggcctcaactggcgtctccgggttaaggatcagccccactttcatgtcatgacggcggatttcatcaatcaggcggaacgcctggccgttgatggtttccggatgcagagtgatgaaatctgctcccgcacgcgccagttgagcaatgtaatcctgcggccgcgtcaccatcagatgacagtcgagcggtttagttgccagttttttaacctgacttacgaagaacggtgagagtgtcagattggggacaaagtgaccgtccatgatatcgatgtggaagtaatcggcatggctgtcgataaattcgatctgttctttaaatttcagcagatccatacacattaacgagggggagattttcatgttcaattccttacttactgataagacggtcaagggcgacagccgcgataattaatccgcccatcaccaccagttggtaataggtttgtacctgcaaaatattcagaccgttgttgatggtgccgatgatcaacccgccaatcaccacagagaaaatgcgccccttgccgccgaagaaactggtgccgccaatgatggcgctggcaatggcataggtttcaaaacccataccggcaagcggttctgcggcaccgagtcgtgcagttgagacgacgcctgccagacctgcacaaacaccggagatgataaacaccaccaggatgtggaatttcacgtcaatcccggaatagaacgccgaatttttgttgccgcccagtgcgtagatgttgcgcccgagccgcatacgcgttgtcagaaaccaaaggatgagcgcgacaattagtgagaagataacggggacaggtatcccaattacgctggcggcaaagaagttcacgaagtcaaatgagaagccgtataccgagttggcatcggagatcaccagcgtgatcccacggaaaatcgcgttggtgccaagggtgatgatgaacgggtgtagccccgtccagttgaccaggcagccgttgatcgcccccagtgcgccgccaaccagtacaccgccaatcatcgctgcgagaaacgggtcaacacctgccaacatcagtttggcggtcaccataccggaaagcgccagaatcgcgccaaccgagaggtcgataccagcgaccaggatagcgaaaaactcgcccatgccgatcaataccgtcacggagctttgaacaaaaatctgggtaatattattggtggtcagaaaatattctggtgacagcgaaccaaagatggcgacgatgatcgccaggataaaaaaggtgccgtatttatcccagaacagcgcaaagttgaacggtttcttctcgctcgcttcgctttttactcttgtggtaaagcccatgccataatctcctcttcgctcatgtcatcgcgattcgtcaggatttgcgtcagtcgtccttcgcagaacacggcgatgcggtcgcagacggtgataatttcaggtagttcagatgacaccatcaggatgacttttccgtcgtccgccagttggcgcatcactttgtaaatttcggctttcgcgccaacgtcgatgccgcgggtaggttcatcgaaaataatcacttccgggcaacagcacagccatttggagatcaggactttctgctgatttcccccggagagttcggtgatattctggtttaccgaatgacatttcagcgccagcagttcgcgttgattttcagcggtacgttgctcgtcaacttcatgaaacaagcccatcgcgcctttatagccgccgtctttcagactgcggctgatcgccatgttctgagcgatggaaaagttggggaaaaaaccgttatcccggcggctttcagtgatgtaagccatcccttttttcacggcatccaggggtgaacgtggagagatatctttgccattaagacggatttctccgccagcgcgtttatccacgccaaacagacaattcatcagttcagtacgtccggaaccgaccagtccggcaaagcctaatatttctccccggcagacgctaaatgagatatcccggaccttttttctgtcacgactggtgacgttccgcacctcaaaaaccgtttcgtgcgcaaggttgctgacattctccttcatcgcgttaaaacggttttgcagttcgcggcctaccatcagacggacgatatcgtcatttgacacatcgcttactatgccgctgcaaacgctgctgccgtctttcatcaccgtatagcggtcgcaaatacggcgaatttccgccaacttatgcgagatatagacgatggccgtaccctctttacgcaactgattcatgatcagaaacagatagtccacctctttattggtgagtgaggaggtgggttcatccatgatgatgactttggcatcgagcatcagcgttttggcaatttctagcatctgcttgtggctgatagataaattcgccactttctcatctagatcaactttcaagcccacgcgtaataacatcatggcggcgcggacacgcatttctcgccagtcgataatattgacgccacagatttttttcgtcagatgacgaccaatatataaattttccagtacggttaattcatcaataacgctgagttcctgataaataatcccgataccgagttgtgccgctaatttatgatccagcttgttatagctaatgttattaatggtaatggtgcctttggtcggctcatgtattccggataaaactttcattagcgtggatttacccgcgccattttctcctagtaatgcatgtatttcaccaggataaaccgttaaattaaccgactttaatgcgtgaaccggaccaaaggacttgccgatccccgccatcgatatatatggcgtggccataaataacctctctgcacgaaatatcgtattattgcctgatggctacatttatcaggtctacgttcaggttattttgttggccggataagacacttcattagcatcatcatccggcatcattcagttttattgagtgaccaggattgaatcgaccagtttaaattccggtgctttatccagcgggataaccttgccggatttctcagcgtcaaccatcagcttcagacccgttgcgccgatatccgccgggttctgggcaaccgtcgcggtcatttgtccggcttccaccattttgcgggcttccggaatgccatctgtaccgacgaccagcacttttcccgtttttccggcgtttgcgactgcctgagcaacacccattgccatcgtgtcattcgcgcaatagatcgctttaatattcggattacgttgcaacacgttagtggcgacatccagtgctttaatgcggtcccagtcggcaggctggctggcgacaagcttgatctggcttgcttttttgaaggcttcggtggcaccattacgacgcgcttcaccggaggcgttaccggctttaccctcaatgattgcgacttcaccaccttcagcgcccaatttgtcaataatgaacgacgcgcctttcgccccgacagcaacgttatcggtggtgacaaaagcttccacattgccgccagcttttttcagattatccatgtcgattttttcatcgagattaaccagataaatgccttttttccatgcgcgggcgacaggcatgaccagattcactgaggataatggagcgaaggcgatacctttgtaatttttattactgagatcttcaaataactgcaattgagattgaaaatcgccttctgaaggagaggcaaaaatatcaacgctgacgcccagtgtttttgcttcatcttcaatgccttttttcatatctacccaaaatgggttggagagggttttcaatacgacagcatattcggcggcagcaaaagcgctggttgacaacattaagcccacgagtgtgccgctgaaatatttcagatatttattcataataatgttctcacggtaaggggacaggtaactccgcgatggcggaattacctttttcttatttcagcgcgcctggtgagaagaaatcaacaattgcgccggttttttgcatattaatattagcttgttcaatgttgagctgggcgacagagacaaaaaaagcgtccagcaaagttagttgtaatattcttgccgaggcattacgacctaataacggcgtttccggggctggtgagcaaataatataatcggccagtttcgctatcggtgaatggtagctatgggttatacaaataatctttgccccgttcttttttgccagttctacggccgcttttacatcactggttcgcccggaatgggtcactaccagcacaacatctccttcctgtaacaacgaagcggacatcatcatgatgtgagcatcaggataggcctgacagcgtacgccaatgcgcaagaacttgtgctgtacatcagcacagatagcatttgatcctccggcaccgtacaaatcccgctgtctggcctgatagaaaaagcgggcggcacggtggatctcatcaacgttgacgatcgactgaccttccataatggtgcgtaaagtgatgttaaataccttattcaccacatcctgcggcgcttcatcaaaagccaactcggaaggcaatacctgttctgactgagaaaaataatcttccagcgcactgcgtaagttacgaaagccgctaaaccccagcagctttgataccttaactatcatcgcttcagataccgccagagcttctgcgacatctttaattgcgggtgcacaactcaggttaccgggtttgagtaaccactccacgatgcggctttcattttctgtcattccttcctgcttcattcgcaggtaaggcgctaaccctataccgttcggaagcgctgaatcaaactctgactggctcatcacgttctcttgtccttgaattgaagacgccactatatcaccacagcaagaacagaaaagatgctggcgacttcacaaaaaaataaaatttataaagtttattttattgtgaacaatggcgagtggcttaaaattttatttcatttaattagtttaaaaacatgatgttatttgtttttctggttttttagatgatagatgttgctggatggtgagtgtctttaacgctattgcgctgtcagatgtaactctgtaaaacagatcaggaaggcgtaattcatcgattttgggtgtttttaattcattaacatcacaaatgttttttgattgtgaagttttgcacggacggggaagatgaatgaaaaagattgcatttggctgtgatcatgtcggtttcattttaaaacatgaaatagtggcacatttagttgagcgtggcgttgaagtgattgataaaggaacctggtcgtcagagcgtactgattatccacattacgccagtcaagtcgcactggctgttgctggcggagaggttgatggcgggattttgatttgtggtactggcgtcggtatttcgatagcggcgaacaagtttgccggaattcgcgcggtcgtctgtagcgaaccttattccgcgcaactttcgcggcagcataacgacaccaacgtgctggcttttggttcacgagtggttggcctcgaactggcaaaaatgattgtggatgcgtggctgggcgcacagtacgaaggcggtcgtcatcaacaacgcgtggaggcgattacggcaatagagcagcggagaaattgagattcatccactacttgcatggatgagtaatgattaatgtggatagagtttctttttgaggttggctaatgaaacgctttccgctatttcttttattcaccctgctcacgctgtccaccgttccggcccaggccgatattatcgacgacaccattggcaatattcagcaggcgattaatgacgcttataaccctgaccgtgggcgagactatgaagattcgcgcgacgacggctggcagcgtgaagtgagcgacgatcggcgcagacaatatgacgaccgccgccgccagtttgaagatcgccgcaggcagctggacgatcgccagcgccagcttgatcaggagcgtcggcaactggaggatgaagagcggagaatggaagatgagtatgggcgatgaggttgggtatggagcaggcatcgcccctcaccccaatggggagagggagaaaacgagcgcaatattcaatatcgagcacaatcggtcccctcgcccctctggggagagggttagggtgagggggccagcgcgcacattccctctcatcacgccaccccaatctccatcccatcaaaccccacctcaaaccctgacggtagtgcgttttccatcagccacgcatcaaactggtggctgatatgggtcagaatcacccgtggcgagcggataacctgattcagcgcaagcacggtatttaaatcacagtgattacgcggtgcatccgcgcgcggcgggtgactgcaatccatcaccattacctgcggctgattattgcgtaaaaatttcagcgttttttccggcaagcctgcggtgtcagacagccacgccacccggctgtgtgccgtttccagcagataaccgaaggtcagttttgagtggttgagcggcaggggcgtgacctgtaacccctgcaaatcaaacaccacaaacggttccaccgtgtggctgaaatcaagcaggcccggatgtttaaacagatcgtcgcagccctgttcatccggcgggccgtaaaccgggatcggatcgccaacgccccagcgcagcggaaacagcccctggacgtgatccatatgataatgcgtcagcaaaaactgctggaacgatccgggcgaccagcgatcggcgagatcgtgcagcccggcgtcgatcagggtgattgcgtcgttaaacttcactacgccgctgcacggttggcggcgatactgcggcgagcgccgcgctctggcgcaggccgcacactcgcagccccatgccggaacgccctgtgcgccgccggtgccggtgagcgtgagggtcaggctcatgttacagcgccttggtgaagcggaagtggctctgctcgtagccttcgcgcagatagaaacggtgcgcgtcgtggcgcttcacgttggtcgaaagttcggtcatttcggccccggcctggcgggcttcttcttctgcccacgccagtaacttactgccgacgttcagaccgcgcgcctgcggcattaccaccaactcctgaatttcgccgatccagttgacatgatgcagatgaaactgcaaatgcaggccgatcatgccgacaacttcgccatcaagcagcgccagatggtagcgcatgtttgggtcgcgcagattggcgttaaaacccacgcgaaacgcgtggtggtcaaactccgcctgttttagctcacaaatcagcgcgtaaaccgcgtcggtgtcgtactgcgtggccgggcgaagctcacaagcaggcatggtgtttctccttctgatggatcagcgtcagcagcgtgtcgaccgactggcgcaggctgccgtcattgttgagcgtatggcaatcctgtggagtatagcgggcggcgcgcgccaggcgggcgttaatttcactggcgttttcacggccacggttttccaggcgctggcggaggatctccggcgaaacctgtaaacagacgggcagcagcgccgattgatagcgcgcccgcgcctgcggcagatgggcgcgtgagccgttgaccagcacgtcgaatccggcgtgcagccagagatcaatctcgacgccgacgccataatacagaccgttagcgtgccagcttaaggccaacagattttgccccgcgcgggtaaaaaactcctgctcgctcagggcgatatggttttcacttccggcgctggcatcgcgcgtgatgtagcgatgcgccaccagtaactgagtttgttcccgcaggcggagttccgccagcaggctgtctttcccggagccggacggccccattaaccaaatcagttttcccatcatcagaacacccttttaccctgacgccagacgtggtcgatatgaatatgattgtccttgcgatgcgccagcaccaggtcggcgcgtttgccctcgccaatcaccccgcgatcctggagattaagcgcctgcgctggatttttagtcaccagcttcaccgcctgcggcagcgtaaagcggttgctctggtcatcggcgacgcgaaatgccgcatcgagcaggctggcggggtagtagtcggaagagaggatatccagcaggccaagctgcgccagttcactggccgccacgttgccggagtgcgagccgccgcgcacaatattcggcgcgcccatcagcacgttcatgccatgcttgcgcgaggcttccgccgcttcgaacgtggtgggaaattcggcgatcacgctgccaagctggtgagattcagcaacgtgggcgtgggtggcgtcatcgtggctggcaagcgcaatttttcgcgcgcggcacagggcggcgatggattcgcgattcggctgcgaccagcgtgcggcgagcgccagttgctcttcttcgtactgctgcatctgcgcatcagtgagggagtatttgccctgataatattcgcgatacttctcgcggttggcgaactggcgctggcccggcgagtggtccatcagcgacaccagcgtcaccggctcgcgctgcaccagtttttcaaacagcggcagcgtggtgtgatgcggcagttcgcagcgcagatgcagacggtgctcggcgcggttgacgccgcgtttctgcgtctcttcgatggcgttgatcatcttctccagattctccagccgatcgccgccgtcgcgcacgtcgccaattgccacggcatccagtacggtggtgatgccgctcgccaccatcagcgcgtcgtggctgctcatcgccgagtgggcaggccagtcaactttcgggcgcggggtgaagaatttatccagattatcggtatgcagctcaatcagccccggcagcagccagccgccttcgccgtccatcgcctccggcaggcggctctggctttcggcaaaggcgcggatttcgccgttctgcacctccagcgaaccgcttaccacctcgttttccagcaccagcttaacgttattgataatcatgaagaggctcccattgggtgcaggcggtcggcgacgtcattacgtacagcttcgtcatggaagatgcctacgatggctgcgccacgggttttggcttcgcgaatcagttccaccaccgcggcgctgtttttggcgtccagcgaggcggtaggttcgtcaagcagcagaatggggtagtcgacgataaagccgcgggcgatgttgacgcgctgctgttcgccaccggaaaatgtcgatggtgccaggtgccacaggcgttccggcacgttcaggcgggtgagaagacgcgcggctttagcggcgcaggcttcacgcggaacgccggtatcgagcagcggctgcatcaccacttccagtgctgagatacgcgggatgacgcgcagaaactggctcacccagccgacggtggttttgcggatttccaccactttgcgcgctggcgcggtgaccaggtctacccactcgtcaccgtgtttgatctggatttgaccttcgtcgggcagatagttggcgtacagcgagcgtagcagagttgatttgccgctgccggaatggccgtggagcaccacgcattcgcccgcgttgacggtgagcgaggcgcgattgaggacgggcaggcgcacgccgttttgctggtgcaggatgaaggttttactgacgttttgtacgttaatcatttttcgcctcgtggttcgggtgtcggatgcgacgctgacgcgtcttatccgacctacggggagcgcatttgtaggccggataaggcgtttacgccgcatccggcaccggctcaattctgcaaaaccgatgacaccagcagctgtgtatacggatgatgcgggtcgtcgagcacgcggtcggttaacccactctccaccacttgcccctgcttcatcaccagcaaacggtccgccagcaggcgggcgacgcctaaatcatgggtgacaatcaccaccgcgaggttcagctccaccaccaggccgcgcagcaggtcgagcaggcgggcctgcaccgacacatccagcccgccggtcggttcatccataaacaccagcttcggatgcgtcaccaggttgcgggcaatctgcaaacgctgctgcataccgccggaaaaggtggtcggcaggtcgtcgatccggttggcgggaatctccacctcttccagccacttctgcgcggtggcacgaatatcgccgtaatgacgtgccccggtcgccatcagccgctcgccgatattgccgcctgccgacacctggcggcgcaggccgtcgagtggatgctgatgcaccacgccccattcggtacgcagcaggcgacggcggtcggcctcgctcattgcatacagcgaacggttctcgtagtgaatttccccctgctgcggcgtcaggcgcgcggagatcgacttcagcagcgtggtcttcccggagccggattccccgacaatgcccagcacttcccccggccataaatcaaaagagacatcgctaaagcctttgcccggcgcgtaaaggtgggtcaggttattgaccgaaagtaacggttgattcattggttttttgcctcgctctgttggcggcaataatcggtatcggagcagacaaacatgcggtttccggcgtcatccagcaccacttcatcaagatagctgtgggtcgatccgcagatggcgcatggctcatcccactgctgaacggtgaacgggtgatcgtcgaaatcgagactttccacgcgggtaaacggcggcaccgcatagatgcgcttctcgcgccccgcgccgaacagttgcagggcgggcatcatgtccatttttgggttatcgaatttcgggatcggcgacgggtccatcacgtagcgcccatttaccttcaccggataggcgtaggtggtggcgatatgaccgaagcgggcgatatcttcatacagtttcacctgcatcacgccgtactcttccagcgcgtgcatggtgcgggtttccgtttcgcgcggctcgataaagcgcagcggctcggggattggcacctggaagataattatctgatcttcggtcagcggcgtttcggggatgcggtgacgcgtctggataaccgtcgcatcgtccgtacgttccgtggtgtttaccccggtcacgcgcttgaagaagttgcgaatcgacacggcgttggtggtgtcatccgcgccctggtcaatcaccttcagcacgtcgctttcgccaatcacgctggcggtaagctgaatgccgccggttccccagccgtacggcatcggcatctcgcgcccgccaaacggcacctgataaccggggatcgccaccgcttttaagatggcgcggcggatcatgcgtttggtctgctcgtcgaggtaggcaaagttgtagccgctcagattagccatggttctgctcctgttgcagacgtttgagtagctccagttcggcctggaaatcgacgtagtgggggagtttgaggtgtgagacaaagcctgcggcttcgacgttgtcggcatgtgccagcacgaactcttcatcctgcgccgggcctgtcgcgtgctcgccgtactccggggcttgcagagcgcggtcgaccagcgccatcgccatcgctttgcgctcgctcatgccgaacaccagcccgtagccgcgcgtgaagtgcggcggctcacccggcgggtcgataaaaccgttaaccatttcacactcagtcatcagcagttcgccgacgttcaccgcaaatcccagctcttccggcacaatcgacacgtcgatatagccgctgcggatctcgcctgcgaacgggtgattgcgcccgtaaccgcgttgggtggagtaggccagcgccagcaaatagccttcgtcgccgcgcatcaactgctgcaaacgggaggagcgtgagcaggggtaaaccggcggcgtgcgggtgatgtcatccggctgtgcgccgctatcctcttcaaacttcgccagcccctgacgcgccagcaggctgaaaacgtgcggcgacggctgctgttcgctgtcggcggtggtcagcgtcggcgcttcgccgtttgccagcagggtaaaatcgagcaggcgatgggtgtagtcgtaggttgggccaagcagctggccgccgggaatgtctttataaacggcggagatacggcgttcgagacgcatcccggtggtgtcgagcggctcgcttaccgccagcttcgccaacgtggtgcggtaggcgcgcagcaggaaaatcgcttcaacgttatcgccgctggcctgtttcagcgccagcgccgccagttcgcggtcggcaatgccgccttcggtcatcacgcgatctaccgcgaggttaagctgctgttcaatctgggcgacgctcagttcgggcaaatcggtatcgcctcggcgtcggctctcttgcagggcgtgggcggcgtcgatcgccttctcgccccctttcacggcaacgtacatcagcacacctccacatgagtggttcgcggaatagccagcaggcgctcgccacaggtcaggatcaggtcgatgccgagcgggaacggatgcgggcgctcggtgagttcgtgcagaatgcactccggcagctgcggagcgatcattcgttcttcggcaatacccgcaccagtaaggcgcaacatgcgtccgccgctcaggctggcgacctgtaaaatcagcgtcgcacccgcttccggcgcaacggcggtgccggtggaaagggcgttgagctgttcgctggaaatcgcctcatccgtcaccgcgaaggtcgcctgttccggctggctgaccagcggcgcgttggtatgaaaacgcaggctctggttgacgatatcgttatttaatggggtagaaagccacaccggcgtgtcgttatcggccagcgtcagcagcacgctggtggtggcgatattcagcggttgccagccgcgtttgagctgatgcagggcgacaatcacgcccggctcgctcatggcctttaacaggcgacgaaaactgtgctgggcatcctgcacgggaagcataaaagcggtttccagggtcatgcgttgtctccgcgaaccatcgtaaagaagtcgacccggctggcgttcacttcggcctggcgtgcggcaatgcgtgccatacggtcagcgtccagcggggcaataagggtttctgataagttttgaaagtggcgagattgctgcatcagcgcgtcaatcagcgcgcagcgttcggcgtgctgtttatcacgcccctgcacccagctgtagccgagcgtgccgtcagtcaggcgcacggcggcgcgggtcagcgtggcgtcgccggcaaaaaaacgttcgccggtgccgcccatccgcgcctgaatctgtaccaggccagtttcagcggcgcggatcacctcatagtcggcggtgatgtttagcgcgttcaggcgtgctgccagttcagccggttggctgtgcgccagcacggacatccagtgctggcgggtcgcggtatctgcgtgcattcagtgctccatagtgaattcaatcatgtcggcgcgcgtcaggctgacggagtactccgccgggctgctttcaccgtcacggtggttaagggtgcgcacgcacagcagcggcgacatattcgggatttcaagacgctggcactctttggcctgggcgcggcgggcgctgatccgcgtctggctgcggcgcagcgcaattccggtttgctcgcgcagaaaatcgtgcagcgagccgctgtcgaagcgttgcagcgtcggccagagggtgaggtccgcgaagtagtggtcgattaaacagagcgcgacgccgttgacacgacgcagggtgcgcaggtggatgacgttctccccctcggtaatccccagtgcgtcagcgacgtggccggacgcggggcgcaataccgaaagcagtttttcgctggtgggatggctgccctgatccagcagattctggctaaaacgcgcctgggcgttgagcgggtaatcgaacgggcgcatcagcaccagcacgccgacgccctgacggcgctgtacccagcctttttccaccagttggtcgatggcgcggcgcagggtgtggcgattcacctcaaagcgcgctgccagttgctgctcggcgggaagatagtcgccgcagcggtagtgttgacgaagctcctgctcaagttttgcggctatctcttgatagcgtgttgggtagctggtcggatgtgtagacaagtgcatagatatcaatgcctcgcttatcagataaagtgcttacgcaaccgttgagagaggaaatccagcaggctgaccgtgacgatgataagcaccatcagggcgcaggtttgttggaactggaaaccgcgaatcgcttcccacagggtgacgccgatcccgcctgcgccgaccatgccgacgacggtcgccgagcggacgttggattcgaagcgatagagggagtaggagatcagcagtggcatcacctgtggcagcacgccgtagaggatctcttcgagcttgttggcaccggtggcgcgaatgccttccaccgggccgggctcaatcgcttccaccgcttcggaaagcagcttggagagcacgccggtggtgtggataaacagcgccagcacgccagcacgccagcgaacgggccgaggccgacggcgaccacgaacagcatggcgaagaccatttcgttaatggcgcggcaggcgtccatcaggcggcgaacgggctggtaaacccaccacggcaccaggttttcggcgctcatcaggccaaaggggatggagagaaccaccgccagcgcggtgccccagacggcgatttgcagcgtgacggccatttcggtgaggtaatcctgccactggctgaaatcgggcgggaagaagtcggcggcgaacgtcgccatgttgccgccgtctttgatcagcgtaagcggggccatttccgcgccctgccacgagacgaccaacacggcgagtacaacggcccagctcagaagcgagaaccagctgcgcttgggtggggcgatggtgatggtttgcatgtttggctccggtctgtaggccggataaggtgcttgcaccgcatccggcatcaacgcctgcacattgtcggatgcgacgccggggcgtcttatccgacctacgatttactgcaccgctttactcaccgaactcatcgcgcttagcgcgttgttcaggcggtccaggtcatccagctgcgcctgaatctcggtggtttttgccagcttgtcctgctcattcagtcctttattgcttttcacgccctgcatctctttaaacagcgcgagctggcgaatcggcaccagttgcaggtcgctggaagcgcggaatggcgcccagcccaggcgttccagcaccgctttttcttccggcgttttgccgtagttcataaagaagtcgtagatcttgtctttggtggtttcggaaagattcttgcgccagacgatcggatcgcctgggatcagcggcgacttccagatcaccttcagttctttcagcttctctggcgcggaggttttcagcttgtcgaggttttcggtgttgttggtggcaacatccacctgcttgttggcgacggccagcgcgttggtttcatgcccggcgttgacggtgcgcttgaagtcgctggcggagatattgtttttggcgaagacgtagtagccggggacgaggaagccagaggtggagttaggatcgccattgccaaaggtgagatctttccgcttcgccagcagatcgttcaggttgttgatcggactgtctttgttgacgatcaacacgctccagtaacccggcgatccatccgccgcgaccgtctgggcgaagacctggccattggcgcgatccaccgcttccatcgccgacagattgccgtaccaggcgatatccactttattgaagcgcatcccctggataatgcccgcgtagtccggggcaaagaaggcgttgaccttcacgcccagcttcttctccatatcctgcaagaacggcgtccattgcggtttcaggttttgctgtgattccgttgaaataatgccgaaattcaacgccttttcctgctcttcggcgtgcgccgggcttaacagggtgctgaggctgaacatgctggtgaaggccagcgaggcaattatcttagcgttcattcgttttcctcaatgatggggatgtcaggcagctttcgcgttctcttcgacgcggttaatgctgcggtagagatggtcaaaacgttcgttatcaaactgttggctgctgccgtcgtagaagacgtgcccctggcgcagggcgacgatgcgttcgcagtagcgcagggcgtaatccacctgatgcagcgtgacgaccacggtgatgccgtcgttctggttgatgtcgcgcagggtgtccatcacgatgcgcgctgattctgggtccagcgaggcgatgggttcatcggccagaatcactttcgcctgctgcatcagcgcacgggcaatcgccacacgttgctgctggccgccggagagggtggaaacgcgctgatgggcaaaatgcaccatgccaacgcgggtcagcgcctgtaacgcgcgctgtttctgctcgccggtgaaccagctaaaacaggtgcgccagaacggcgtgctgccgagcgcgccaatcagcacgttctccagtacgctcaggcggttcaccaggttgaattgttggaatatgtagccggtatgggcgcggcttttgcggatatcgcgggccaggcggccttcgcgctggactgtgcggcccagcagctcgatatggctaccgacagatttatcgccggtaatcaaaccgcttaagtgacgtaaaagggtggattttccggaacccgacggcccaagcagagccaccatttcaccgtgatgaatgttcagatcaaccgcatgcagcgcctgatgctgattgaaggttttggcgagcttctcgacacggataatcgtttgcatgatgcagcctccctaaaaaagtggctccatcgtggcggattattgtgacgatttggttaattaaaagtgactaacagatgaagagttaacgggaattcgatgacagtgcgggagggcgggcctcccggcgggttattgcgttggttgttgtttgacgacattaatcatccacggtacgccaaatttatcggtgactttgccaaagccatgcgcccagaaagtttcctgccaggccatttcgatttttccgttagcggcaagattgtcaaaccagcgttttccttcttcgacctgttgcgaatcgagcaccagcgtaaagccggagtagctggcttttcctgacggcatggcatcgctcatcatgatgtcgcttccggcaatgcgcacattggcgtgggcgatggcggtatcgggaaattgcattccggaagggcagttctcggcgctgtcctgcgctgattttggcatttcgccgaagctgattttatagagcagttccgcgcccaacgtacgttgataataggcaatcgcgtcggaacagttaccggcaaaagagaggtagggacttaacggcatgatggtgacctcagttaagagaagccagttaagtgtagttcgaaatttatacagatgagaggcggcctgataagacgcgcgagcgtcgcatcaggcagtcggcactgttgccggatgcggcgtaaacgccttatccggcctacggagggtgcgggaatttgtaggcctgataagacgcgcaagcgtcgcatcaggcagtcggcaccattgccggatgcggcgtaaacgccttatccggcctacggagggtgcgggaatttgtaggcctgataagacgcgcaagcgtcgcatcaggcagtcggcaccgttgccggatgcggcgtaaacgccttatccggcctacggatggtgcgggaatttgtaggcctgataagacgcgcaagcgtcgcatcaggcagttggcactgttgccggatgcggcgtaaacgccttatccggcctacggagggtgcgggaatttgtaggcctgataagacgcgcaagcgtcgcatcaggcagtcggcaccgttgccggatgcggcgtaaacgccttatccggcctacggagggtgcgggaatttgtaggcctgataagacgcgcaagcgtcgcatcaggcatctggcaccgttgccggatgcggcgcgagcgccttatccggcttaccgatcacaatacaatcagttctttttcacaaactcagatttcagtttcatcggaccaaaaccgtcgattttgcaatcgatgttatggtcgccttcaaccaggcggatgtttttcactttggtgccaattttcagcatcgaagagctacctttcaccttcagatctttaatgatggtaacgctgtcgccgtcagccagcagattgccgttagcatctttaacgatcagctcgtcgctttcctgtgcaggttctgcgtcgttccattcgtaggcacattccgggcagatgtacatgccgttatcttcgtaggtgtattcggagttgcattttgggcagtgtggtaatgacatgtggatttcctcaaaagtcagcagggcaaaagcgccaaaaaacggcagattgccgaaaaaggccgcaattatacacaaaatccctgagtttgtcgggggtactgctgattttagacgacgatcgttttcatttgaaaggaaacgcaaaaagaaaataatctttttgcctctatttattatttaagataatgttaatgctctacttgttctttttttaattcacatgatatttttatctttctgacgttttaaacgtatcagaagacgttatttattctgataaaaaacaacacactaaatataaaattatttcttgcagtaattataaaagccgaaaacagaactcaaaaacaatctggctaaataaaataacaaaatttgctttaaggaagaattttctatgtacacacagaccctgtatgagttaagtcaggaggctgaacgcctgttacagctttctcgccaacagttgcagttactggaaaaaatgcctctctctgtacccggagacgacgcgccacaactggctttaccctggagtcagcctaatatcgccgaacgtcacgcgatgctgaataatgagttgcgtaaaatttcccgactggaaatggtgcttgcaattgtcggtaccatgaaagcagggaaatcaaccaccattaatgccattgttggtacggaggttctgcctaatcgtaatcgcccaatgactgcgctgccgacgcttattcgccatacgcccgggcaaaaggaaccggtactgcatttttcacatgtcgcgccaatcgattgtttaattcaacaattacaacagcgcctgcgtgattgcgatattaagcatctgaccgatgtgctggaaatagataaagatatgcgtgcgcttatgcagcggatcgaaaatggcgtcgctttcgaaaaatattatctgggtgcccagcctatttttcattgtctgaaaagtttgaatgatttagtgcgactggcgaaggcgctggacgtcgattttcctttttctgcttacgccgccattgagcatattcccgtgattgaagtggagtttgtccatctagcggggctggagagttatcccggtcagttgacgttactggatacccccgggccaaatgaagccgggcaaccgcatctgcaaaaaatgcttaaccagcagctggcacgcgcctcggcggtactggcggtgctggattatacgcaactgaaatcgatctccgatgaagaggtccgtgaggcgattttggcggtggggcaatcggtgccgctgtacgtgctggtcaataagttcgatcaacaggatcgtaacagtgacgacgccgaccaggtgcgggcactgatttccgggacgctgatgaaaggctgtattacgccacagcagatatttccggtgtcgtcgatgtggggctacctggcgaatcgggcgcgctatgagttagccaacaacggtaagttaccaccgccagagcaacaacgctgggtggaagattttgcccatgccgcgcttggcaggcgctggcgtcatgccgatctggcggacctcgaacatattcgtcatgctgccgatcagttgtgggaagattcgctgttcgcccagccaattcaggcgttgcttcatgccgcttacgctaacgcctcgttgtatgctctgcgatctgccgcgcataaactgttgaattacgcgcagcaggcgcgggaatacctggattttcgtgcgcacgggttaaacgtcgcttgtgaacaattgcggcaaaatatccaccagatcgaagaaagtttgcagctattgcaactcaatcaggcgcaggtgagcggcgagattaaacatgaaatcgagctggccctgacctccgccaaccactttctgcgtcaacagcaagatgcgctgaaggtgcagttagccgccttgtttcaggatgattcggagccgttaagcgagattcgtacccgctgtgagacactgttacagacggcgcagaacaccatcagtcgcgactttacgctgcgttttgccgagcttgaatccaccctttgccgggtgttaaccgatgttattcgccccattgagcaacaagtcaaaatggaattgagcgagtcagggtttcgtcctgggtttcattttcctgtttttcacggcgtagttccccacttcaacactcgccagctgttcagtgaagtcatttcgcgccaggaagcaacggacgagcagagcacgcgtttaggcgttgtgcgtgagactttttcgcgctggttgaatcagcccgactggggacggggaaatgagaaatcaccgacagaaacggttgattacagtgtgttgcaacgagcattaagcgcagaagtcgatctctattgccaacaaatggctaaagttctggcagagcaggtcgatgaatctgttacggcaggcatgaatacttttttcgctgagttcgcttcatgtttgacggaattacagacgcgtttacgcgaaagtctggctctgcgtcaacaaaatgaatcggtggtcaggctgatgcagcagcaattgcagcagactgtgatgactcacggctggatttacaccgacgcccagctgttacgcgatgatattcaaacacttttcacggcagaacgatattgaccaagacgttacttgacggccccggtcgcgtgctggagtcggtttatccccgctttttagtggatctggcgcagggtgatgatgcccgccttccacaagcccatcagcagcagtttcgtgaacgactgatgcaggaacttctttcgcgtgtgcagcttcagacatggacgaacggcggcatgttaaatgcgccgcttagcctgcgtctgacattggtggaaaaactggcgtcgatgctggatcccggtcatctggcactgacgcagatcgcgcagcatctggcgctgctgcaaaaaatggatcaccgccagcactctgctttcccggagctcccccagcaaattgccgccttgtatgagtggttttcagcccgttgtcgctggaaggaaaaggcgttaacgcaacgaggcctactggtgcaggcaggtgatcagagcgagcaaatttttacccgctggcgtgctggggcgtataacgcctggtcgttgcctgggcgctgttttatcgttctggaggagttgcgctggggggcatttggcgatgcctgccgtctgggaagcccgcaagcggtggcgttgttgctgggtgatttgctcgagaaagcgacacaacatctggcagagagtatcaatgcggcaccgaccacgcgtcactattaccatcagtggtttgcctcttcgaccgttccgacgggcggggagcatgctgattttttaagttggctgggaaagtggaccacggcagataaacaacccgtttgctggtcagtgacccaacgctggcaaactgtcgcgctggggatgccacgactctgttcagcgcagcgtctggcgggggcaatgctcgaggaaatcttctctgtaaatttggcgtaaataatcagttacatcaatgagtcctaaacgaaatccatgtgtgaagttgatcacaaatttaaacactggtagggtaaaaaggtcattaactgcccaattcaggcgtcaactggtttgattgtacattccttaaccggagggtgtaagcaaacccgctacgcttgttacagagattgcatcctgcaattcccgctccccttttgcggccgtcgcgctgatttttctggcgtttgcggaaatgggccaactctgcgaggaaagctatgctgaaaaggaaaaaagtaaaaccgattacccttcgtgatgtcaccattattgatgacggtaaactgcgtaaagccattaccgcagcatcactgggtaatgcaatggaatggttcgattttggtgtttatggttttgttgcttacgcattaggtaaagtttttttcccgggggctgaccccagcgtgcagatggttgctgcacttgccactttctccgttccctttctgattcgaccgcttggcggactcttctttggtatgttgggcgataaatatggtcgccagaagatcctcgctatcactattgtgattatgtcgatcagtacgttctgtattggcttaataccgtcctacgacacgattggtatttgggcaccgattctgctgttgatctgtaagatggcacaaggtttctcggtcggcggtgaatataccggggcgtcgatatttgttgcggaatactcccctgaccgtaaacgtggctttatgggcagctggctggacttcggttctattgccgggtttgtgctgggtgcgggcgtggtggtgttaatttcgaccattgtcggcgaagcgaacttcctcgattggggctggcgtattccgttctttatcgctctgccgttagggattatcgggctttacctgcgccatgcgctggaagagactccggcgttccagcagcatgtcgataaactggaacagggcgaccgtgaaggtttgcaggatggcccgaaagtctcgtttaaagagattgccactaaatactggcgcagcctgttgacatgtattggtctggtaattgccaccaacgtgacttactacatgttgctgacctatatgccgagttatttgtcgcataacctgcattactccgaagaccacggggtgctgattattatcgccattatgatcggtatgctgtttgtccagccggtgatgggcttgctgagtgaccgttttggccgtcgtccgtttgtgctacttggtagtgttgccctgtttgtgttggcgatcccggcgtttattctgattaacagtaacgtcatcggcctgatttttgccgggttactgatgctggcggtgatccttaactgctttacgggcgttatggcttctaccttgccagcgatgttcccgacgcatatccgttacagcgcgctggcggcggcatttaatatttcggtgctggttgccggtctgacgccaacgctggcggcctggctggtcgaaagctcgcagaatctgatgatgcctgcctattacctgatggtagtggcggtggttggtttaatcaccggcgtaaccatgaaagagacggcaaatcgtccgttgaaaggtgcgacaccggcggcgtcagatatacaggaagcgaaggaaattctcgtcgagcattacgataatatcgagcagaaaatcgatgatattgaccacgagattgccgatttgcaggcgaaacgtacccgcctggtgcagcaacatccgcgaattgatgaataagctgaaacggatggcctgatgtgacgctgtcttatcaggccaattgaactcttaaggttcacttaatctctgacgcgcatactctcctccaggttaacggaggagagtgcaatgaaaaaccgtgtttatgaaagtttaactaccgtgttcagcgtgctggtggtcagcagctttctttatatctggtttgccacgtactgatctttcttcagccgtacccaggcccgcgtgccggaagtctcttgccggttttgcaggaaaaactgcccgtgatgcaactgtgtaatgcggctgacaatacttaaccccagaccaatcccgccataacggctgtccatacgtacaaacgctttactcaactccccgcatttactctcatcaatacctggtccttcatcttcaactgccatgaccgctccgtcatcttcttgcagcttaatcataatgttgctgccttgcgggctgtaacgatgggcgttttctaccaggtttcgcaataacatccgcagcagggttgcatcaccctgaacggtgatgtcggcggcgctctctggcaatagcagggtttgctgtcgctggtcgagcatggtactgagttcgtcatacgaggggagaatgacatcttccagcagttttacatgttgataattaccggaagaaaatgactgtccggcacgcgccagttgcagcagctgggagacgctctccatcatctgatcaagccgtgccactaacggtgctacatcaatgtgatgcgttttcgccagcagttccagatgcaaacgcacccccgccagtggcgttcgcagttcgtgcgcgacgtcagcggtaaacaacctttcgttatccagcgtgctggtcaggcgactgaccagatcgtttaacgccgaaaccaccgcttcgatttcgagggtggcgctgtgaatggcaatgggcgttaagttgtcggcggtgcgcgcttccagctctttttgcagctccgccagcgggcgggtgatgcggcgtaccgcctgatagcagataaatagcgtcaggctgaccataaagacgccggggacaatcaggctggcgaccgcctcgcggatctcacgcatgatgtggcgatcgttgttgcgattgtcgcgtagcgcctgctcaaacagctgaatctgctcggtactttcatgccatagccagaagacgctgatcagctcaaacaccaacaaaatggccccgatggtcaatatcagccgttggcgcagcgatattggtcggcgcagaaaatgcatcagattcaattagttttcctcattcgcgaccagcatatagccaaagccgcgcacggtgcggatacgggctttgcccactttgtcgcgcagattgtggatatgcacttccagggtgttggtcgagggttcattgtcccagttatagatgtcgttgtagagaatttcccgatgcaccggactgcctgctttgagcattaaccgtgacagcagagcatattctttgggcgtcagaatcaactcttcaccgcccatccatacctgacggcgacccatgttcagcgtcagattgccaacaatcagctcactttcgccctgattattatggcgtcgtagcagggcgcggatacgggcatgtaactcttccagcgcaaaaggcttcaccagatagtcgtcggcaccgacatccagcccggcgattttgtcggtcagcgtatcgcgagcggtgaggatcagtaccggcagggtatattttttctgccggatacgggcgagaaaatgcagtccatcttcgtcgggtaaccctaaatccagtaccaccaggctgtaatgacctgcctcaaggctttgttccgccatccgcgcggttgtcacgctatcgcacgcgtagccttcggtttgcgccgccagaatcagtccctgcaataacagcgtatcgtcttcaacaatcagaattttcattcactcactctcctgcaagtttgcagaatatcatccgcagcctggtaatacttcgtctcaacgccagttaatcccaatagcgtggagaataaattgtcttgtgaatagtgttgcgtttgcgcctgtttttgcaggcagttctggtcaacctgataccgtttttgataatcctccgacagccacagcagcatcggcacctgtttttggctatccggggcgatggcataaggcagaccgtgcagatagatgccattttcacctaacgattcaccgtggtcagaaagataaaccaggctggtggtaaatttatcctgatgttctttcagcagattaatcgctttatcaacaatatagtcgacgtaaaccagcgtgttgtcgtaagtgttcaccagttgctctttggtacaggtctggatctcattggtgtcgcaggttggggtaaatttcctgaactgaggcggatagcggttgtaataggtcggaccgtggctgccgatggtgtgtaagacaatcacgccatcaccttgcaggttattgatgtactcttcaagcccgtggaacagcacttcgtcatagcattcgccgttgatgcactgatcaggtagattcagcgcggtgacgttctggtgaggcacgcggtcgcaggcacctttacagccgccatcgttgtcattccacagcacgttgatgcccgctcgctgaatgatatccagcacgccttcctggtgctgtgccagctcttctttgtagtgctcacgcggcatatccgagaacatgcacggtactgaaactgccgttgccgtgccgcaagatgcggtattagggaaatagaccacgttatctttcgccagccgcgggttagtttcacgcgggtagccgttgagggagaagttctccgcccgcgaggtttcgccgacaatcaggatggtcaaatttttacgtttttcgttctgcattaacgggttgcggtgcgcgtcttcaccaattcgcaccagcggcagatttgccagtcgctgatgggagtaccatgaccagctggcaacaatgctgttagaggggcttaaggatttcaccagctctttgttattgcggaacaacgaggcgtagtctttataaaacagtgcggcgaccagcaaaatcagtagtacagaaaccagaatattggctccacggaaaagaacactgcgcagacgcgaggtggcaggtttgatttttatccagcaggcaatcagcgcagcaagcacgccgctgaatcccagcgttaataacatttgcggtgtcatcagcgcataactttctgccggagtggtatcaataatattggcaatcatcgagcggtcgatgacgatgccgtaagtcattatgaaatattgtgcagccgcgccaaccagaataaacaggcaggccagtggtcgattaagccataagaaagagcttagtgtcaggacaatattaatcacgctgaaagcgacgaccggcatcgacaagaaaaccagtacgttatgcagcgaatccagcggcagcgcctgcaacacctgtttaaaaaaggcaatattcaggcagatagagatataaaaagcggccaacaatagccaggcgagtaaattcaaagagggtctttttagtaggcgcttcaacatcacggtgtttccatcgaacaaagtgcgcatatgctcgcaaagcaaaattaagccaaccttaagttcttaaggttggcttttatgtttgctggattaaggggaattaatctttgcttattggtgcatctaagggatacgggtttttatgtagccggttgtaattcagcgcatacatggcggtgatgaccatcagggtgacaaatgaccacataacctctttcgctccggaccccaccacggcccagatgcagtagaggaaggcaatggtagtaactgccagatatgccgggcgtgctttaccaaagtgaccgtgtccgagcagcagtaacgccgcacaggtgtaaagatatggcaccagtgtaaagatgaccgagacggaagaaaccagaccgaactctttggtcgcgtttggtgaaatgctgctgagctggaagatggtcatcaaaataccgacgataatcagccccgccactggcgtacccgctttatttacacgggcaaaaatcggtgggaacagtccgtcatcggcagcggctttcgccgtttgacccgccagcaacgtccagccgcccagtgaacctaagcaacccgcagctgcgcagaaggaaacaatggccccggcggtgtcacccaacgccatccgtgcggcatcaccgaatggcgaagcagaaacgcgcagtgcggcattagggatcatccccataatcgcggtggtagaaagtacatagcaaacggcggcaatcaataccccaccaatggtggcgatagggacattgcgtttcgggtttttcaccacacctgcggcaacggaggcactttccacaccgatgaacgaccacagcgtaacgttaagggtactttgaattgcaccgaaggtgcccaggccgctgacgttccatgccgccatataggtttcaccacggaaccagaaccagccaaatacggcaatcccgacgatggggatcagcgccagcacggtggcaactgcctgcacacgggtgatcattttcggaccgacaatgttcagcaggacgaagatccacagcaccacgacgcaggtgatggttaataccaatggatctttcagaatcgggaagaagtaacttaaatatcctacgccaatgaccaccatggcgatattgccgatccagcaggccagccagtagaggacgttggtttgataaccgagaaacgggccaaagcagcggcgggcgtaagcgtaagaaccaccaggacttgggtcgaggaacgacattttggcgtataccatcgagagccccagtgcaccgataatcgtcaccaaccatccataaatggcaatcccgccagtagaggccaggtttgcaggtaacagaaaaacacctgaccccataatattccccgacaccatcagggtgacggggattaagcccactttgtgagcatcagcatccgaagacataattaaactcctgcgaaggcgagcttcgtgacaataaattacgtcatatcatacgcctgcattcgatagttgaattattatcgaccgggttatcgctgatgccgttattaatatagctcttcgttaaggttaaaaatcaggcgacagtgcgttctctgtgctgactaacataatgcagcggcgtcataccgtagaagtctttaaagacagaaataaagtacgacgtactgttgtagccgcaggactgtgatacctgagagatatttttaccgtccatcattaattcatttacggcataacgcatgcggcaggtggtgattatttggctataactggtgttttcgcttttcaactttttctttaacagacttgggctaagacataaacaactggctaccatactaagattccagtctttgtgaatatcgctttcaataatttgataaacgctgtcacttacacaattacgtaacatatacatcattaatgaaacgaattttttactgtcgagaaaacgggatagcaccgtgaataataatgcgcgtgttcgttccttttctgactcagtttctgcgggcatcatgctgtgttgcgcggcaacgcgaaagacgtctggcgtcaggcatggcagggtgagtatgggcgtagcgctacgttgccatactggtatttgcgagagatctttattcagaaaccggaggtaatctttgatgatgtcgtgactaatatgagcaaccaaagtgttgttaagagaggagacgtcgataatattattttcacaatttaataacgccatatggttagctttaaggctaataggttctttcccattcacccttatccagacatctttttcagtcaataaaacaatacaaggttggtcgctgcaaatcctcatacatgtactcctgagtgcgaataaaagaccagttctcgctaaagcaaagcgataccgggaaatggttatataattgtatgatgaatataaacatgcataaaaataacgagttttactaatagtacaaatttttatagtaatttctcatgtacatatttttttacaggataaataacaggcaaaaaaaagcgcggggtggggccgcgcaaaaagtatgacatttttgtttgcagcaatttttatgaaaacgttgccatactcaaaaggcctaaggccaggcggcgtaatgttatttaaacaattacgccttcagcggaatagtggttacgctttcacgcacataacgtggtaaataccgtcaataatttcagtcccttcagtttcgtgttcaaatccagggaaatggtggtcccaggattgcagcgagcgtaaataacttacttgcggactgtttttatcgccgaagttttcaccagacagcagcatcgggattcctggcggatacgggataactgagtttgccgcgatgcgtcctggcagattttcaatggataccagttcgacattgttgtcgacaatcgcgttgtacgcttcacgcggggtgacttccgccaccggcaggccggaataggcttcgttcaaccgtgcgccagggttgttttctttcagccaggcaaacatggtgtcacccagatcgtgaatccccatgttcgcgtaagtgtcaggatattgttcaacaagttccggcatcacctgcgccagcggtgtgttggcgtcatagtggcgtttgaaggagcaaagggtgttaaccagagttccccatttcccacgggttacgcccatagagaacaggaacataatttggaagtcagtggtgcgggtaggtacaatgccgtggcgaccaagccaggcagtgaccagcgccgccggaacaccggtttcttccagttcaccatcttcacccattcccggagcaaggatgctgactttaatcgggtcgagcatactccagttatccggaatatctttgaagccgtgccagctttcgcccggatgcattacccagcagtcctgaacggtggtcagcagtttggttggtgcgtcagcaaagtcataggttttgccggtttgtgggtcggtgacgacttctttgttccacggtttgaagaaccagctaccgtcagcggtgaactctttatatagccgcgccatcgcctgacggaaatcaaccgcttcgtcaatcacttcctgtgtcagtgacaggccgctgttgccgtccatcatcgacaccgccacgtcgttggatgcgcagatggcatacagcggggaggtggtggcatgcatcatgtaggcctggttgaagcgggagaagttaatcgccccacgaccttcacgtacatgaatataagaagcctgtgacagcgcattcagcagtttgtgggtggagtgggtggcgaaaacggtaggaccgttgtgatcgccaggttcgccgcgcatggcatagtgatcggcatagatcgggttgaaacgtgcatagccgtaccaggcttcgtcaaagtgcagacgatcggaggttttttccagcagatcctgcgcttctttagcgttataacacacgccgtcataggtgcagttggtcaccacgcagtaagacggtttttgcccggctttgtctttggtcagcgggctttcactgattttcttctgcaaggtttcaggttgcatttcctgcggatagattggcccgataatgccgtagcggttgcggcttggcaccatatagaccggtttcgcgcctgtcagcatcaaaccttgttcgatggatttatggcagttacggtcaacgaccacgacatcgttatcggtcatgcaagcctgcatgatggtgcggttagagccggaagtaccgacgactaccgaccaggagcgatcggcaccaaatacgcgtgcggcatatttttcgctttcgccaaatgcgccagtatggtcaagcaaagaaccgagggaagttcgttcgatgcccatgtcggtgcggaacagattttcaccatagtagtcatggtagaaacgtccggcgggtgttttggtaaaaccaacgccgccctggtggcctggcgctgcccaggaatattcatggatgtcactatatttcatcagcgcgctgaacagtggcggcaacagctgctggcggtagcgggtcatcgcggcaacggcgcgtccggcgataaagtcggcggtatcttccagaatccaggcgaattcatcgacaagctccagcaggtcgcgatccattgcggcgagggctttttcccgatcgcccaacaggaagaccggcacgttttgttggcgctcatgaagcttaccgatcaattgtctgacgttttgatgttcgtccggatgttccatttgatagctgaacatcaggcagtcaatggcttcgtttgaagagagaatggcaaaaccatcatcaaaggaggtggatttaatcacggtaacattttgctggcttaaagcatctgccagacgctcaacggcgttaccgacccaggtgtcttgatggagaaactcgctttcaacaattaatactttcatcattgcttacccggttatgaaggaatcttcgttgcgggcaagtatcttccggccttttcgggctgtaaagcgcgtgaaaaacaaacatttttgaaatatttagttttataaacaatacgttatgtgattattttaaattattttcactgcttattatcgacggctaaactatttttttggctgatactgatatcgtctttagccgggaaacgtctggcggcgctgttggctaagtttgcggtattgttgcggcgacatgccgacatatttgccgaacgtgctgtaaaaacgactacttgaacgaaagcctgccgtcagggcaatatcgagaatacttttatcggtatcgctcagtaacgcgcgaacgtggttgatgcgcatcgcggtaatgtactgtttcatcgtcaattgcatgacccgctggaatatccccattgcatagttggcgttaagtttgacgtgctcagccacatcgttgatggtcagcgcctgatcatagttttcggcaataaagcccagcatctggctaacataaaattgcgcatggcgcgagacgctgtttttgtgtgtgcgcgaggttttattgaccagaatcggttcccagccagagaggctaaatcgcttgagcatcaggccaatttcatcaatggcgagctggcgaatttgctcgttcggactgtttaattcctgctgccagcggcgcacttcaaacgggctaagttgctgtgtggccagtgatttgatcaccatgccgtgagtgacgtggttaatcaggtctttatccagcggccaggagagaaacagatgcatcggcagattaaaaatcgccatgctctgacaggttccggtatctgttagttggtgcggtgtacaggcccagaacagcgtgatatgaccctgattgatattcactttttcattgttgatcaggtattccacatcgccatcgaaaggcacattcacttcgacctgaccatgccagtggctggtgggcatgatatgcggtgcgcgaaactcaatctccatccgctggtattccgaatacagcgacagcgggctgcgggtctgtttttcgtcgctgctgcacataaacgtatctgtattcatggatggctctctttcctggaatatcagaattatggcaggagtgagggaggatgactgcgagtgggagcacggttttcaccctcttcccagaggggcgaggggactctccgagtatcatgaggccgaaaactctgcttttcaggtaatttattcccataaactcagatttactgctgcttcacgcaggatctgagtttatgggaatgctcaacctggaagccggaggttttctgcagattcgcctgccatgatgaagttattcaagcaagccaggagatctgcatgatgtctgcacccaaaattacatttatcggcgctggttcgacgattttcgttaaaaatattcttggtgatgtgttccatcgcgaggcgctgaaaacggcgcatattgccctgatggacattgaccccacccgcctggaagagtcgcatattgtggtgcgtaagctgatggattcagcaggggccagcggcaaaatcacctgccacacccaacagaaagaagccttagaggatgccgattttgtcgtggtggcatttcagattggcggttatgaaccttgcacggtgactgatttcgaggtctgtaagcggcatggtctggaacaaaccattgccgatacgttggggccgggcggtattatgcgcgcgctacgtaccattccgcatctgtggcaaatttgcgaggacatgacggaagtctgccccgatgccaccatgctcaactatgttaacccaatggcgatgaatacctgggcgatgtatgcccgctatccgcatatcaaacaggtcgggctgtgccattcggtgcagggaacggcggaagagttggcgcgtgacctcaatatcgacccagctacgctgcgttaccgttgcgcaggtatcaaccatatggcgttttacctggagctggagcgcaaaaccgccgacggcagttatgtgaatctctacccggaactgctggcggcttatgaagcagggcaggcaccgaagccgaatattcatggcaatactcgctgccagaatattgtgcgctacgaaatgttcaaaaagctgggctatttcgtcacggaatcgtcagaacattttgctgagtacacaccgtggtttattaagccaggtcgtgaggatttgattgagcgttataaagtaccgctggatgagtacccgaaacgctgcgtcgagcagctggcgaactggcataaagagctggaggagtataaaaaagcctcccggattgatattaaaccgtcacgggaatatgccagcacaatcatgaacgctatctggactggcgagccgagtgtgatttacggcaacgtccgtaacgatggtttgattgataacctgccacaaggatgttgcgtggaagtagcctgtctggttgatgctaatggcattcagccgaccaaagtcggtacgctaccttcgcatctggccgccctgatgcaaaccaacatcaacgtacagacgctgctgaccgaagctattcttacggaaaatcgcgaccgtgtttaccacgccgcgatgatggacccgcatactgccgccgtgctgggcattgacgaaatatatgctcttgttgacgacctgattgccgcccacggcgactggctgccaggctggttgcaccgttaaaacgcgactaaacgctactgcgccgggggatttattccggcgcacacctctgacgataccaataacagaaggcgggcgttggtaacagcgacccgataccctatgagcatttcaatgactacaaaactcagttatggatttggagcgttcgggaaggattttgcgatcggcattgtgtatatgtacctcatgtattactacaccgatgtcgtcgggctgtctgtgggtttggtcggtactttgtttctggtggcgaggatctgggatgctattaacgatccgattatgggatggattgtaaatgctacgcgatcgcgatggggtaagttcaaaccctggatcctgatcggtacgttggcaaactctgtaatcttatttctcctctttagtgcgcatctgtttgaaggtactactcagattgtctttgtttgcgtgacctacatcctctggggcatgacttacaccattatggatattcccttctggtcgctggttccaaccatcacgctcgataaacgtgagcgcgaacaactggttccttatccgcgtttttttgccagtctggcaggctttgttacggcaggtgtgacgctaccatttgttaattatgtcggcggtggcgatcggggatttggctttcagatgttcactctggtactgatcgccttttttattgtttcaaccatcatcactctgcgcaatgtgcatgaagtcttttcgtcagacaatcaaccgtctgctgaaggaagccatctgacacttaaagccatcgttgcgctaatttataaaaacgatcagctttcatgcctcttgggtatggctcttgcttataatgtagccagcaacattattaccggctttgctatctattatttctcatatgttatcggtgatgcggatttgttcccctattatctgtcgtatgcgggagctgctaacctggtgacgttagtattcttcccacgcttagttaaatcattatcccgacgcattttatgggccggagcatctattcttccggtgttaagctgtggtgttctcctgttaatggcattaatgagctatcacaacgtcgtcctcattgtgattgcgggtattttgctgaatgtgggaacggcgcttttctgggtattacaggtcatcatggtggcagatatcgttgattacggtgaatataaactgcacgtacgctgtgaaagtatcgcttactccgtgcagactatggtggtgaagggcggttcagcctttgcggcttttttcattgcggttgtgttagggatgattggctatgtaccgaatgttgaacagtctacgcaagccctattaggtatgcagtttattatgattgctctaccaactctgtttttcatggtaacgctgattctctacttccgtttctatcgcctcaatggtgacacgctgcgcaggatccagatccatctgctggataaatatcgcaaagtaccgcccgagcctgttcatgctgatattccggtcggtgcagtgagtgatgtgaaagcctgacgtggacaatagctaacgaaaatggcctgatgcgatatgtttatcaggccacgtcttaatgtaatgctttggatttgcaaattttgtagaccggataaggaattcacgccgcatccggcatcaacaaagcgcaagttgttatccggttatcaagccaaagcgccgtagctggcggcaatgaaagcgagcgaggaatatcaccgtcgttaatgcgccaagcagcgcgcagaacatatcggattgcgtgtcccactggtcgccctgggtgccgagaaaatcatccgctccctgacccattgccagcgctgcccaccactcgattaattcatacatcgcgcttatcgccagcgccacgcagcagaccaggaacgccaccattttacgtccgcgcacgtacatcccgcgaacgagaatttctcgtgccaccagtgcaggcaccagcccctggaaaaagtgccccagcttgtcatacggattacgactcaaccccagccattcctgcacctcaaaaccaacggggactttcgcgtaggtgtattgtccgccgaccatcaggatgatggcgtgaaggaaaatgagcgtatagagcagcggcgttaacggataacgtctggcggtggcaagcagtagctgcacgacaataatcaccggtgtcacttccatcagccaggtgagtttgtcatgggccgaaatgccggtataaatcaggattaacgttagcgtcagtgcgctggtgttaagaattaacggcttgagtgtgcgggtcatggtgagttcgcaaatcagggaaaatactgactattcaccagcaagcgtgaaattacaatcgcaaaagaggtggccagggggatcacctggcagcatgctgccaggcgctgggccgaagaggttacttagtgcagttcgcgcactgtttgttgacgatttgctggaagaagtcgttacctttgtcatcgaccaggataaacgccgggaaatcttctacttcgattttccagatagcttccatacccagctccggataagcgacgcactccagatgcttgatgctctgctgcgccagtaccgccgccggaccgccgatgctaccgaggtagaagccgccgtgtttatgacacgcgtcggtaacctgctgactgcggttacctttcgccagcatgatcatgctgccgccgtgggattgcagcagatccacgtaggagtccatacggcctgcggtggttgggccaagtgaacctgatggataaccggcaggggttttcgccggacccgcgtagtagatcgggtgatctttgatgtactgcggaagttctttaccggcgtcaatcagctctttcagcttggcgtgtgcaatatctcggcccacgataatggtgccggtgagcgacaaacgagtggataccgggtattgcgaaagctgggcgaggatctctttcatcgggcggttaaggtcaactttcaccgcttcgccttcaccggcctggcgcagttcttgtggaatgtactggcctgggttgtgttccagtttttcgatccagataccttcgcggttgattttcgctttaatgttacggtcagcggagcaggagacgcccatgccgaccgggcaggatgcgccgtgacgtggcagacggataacgcgaatgtcgtgcgcgaagtatttaccgccaaactgcgcgccaagaccgagtttctgggcctcttccagcagttcctgttccagctggacatcgcggaacgcctgaccatgttcgttcccttccgtcggcagttcatcgtaatagtgagcgcttgctaacttgacggttttcaggttggtttccgcagacgtaccgccaatcacaaacgcgatatggtacggcgggcaggctgcagtaccgagggtacgcattttctcgacgaggaagtttttcagtttgccgggagtcagcagggctttggtttcctggtagagatacgttttgttggcagagccgccgcctttcgcaacgcaaaggaatttgtactcatcgccatctaccgcgtacaggtcgatttgcgcaggcaggttagtgccggtgttgacctctttgtacatgtccagcgccgcattctgtgaatagcgcaggttatcttcgatataggtgttatagacgcctttcgacagcgtttcttcatcaccgccgccggtccacacgcgctggccttttttaccgacgatgatcgcggtgccggtatcctggcaggtcggcagcacgcctttggcggcgatttcggagtttcttaagaattgcagcgccacgtacttgtcgttttcgctggcttctggatcgtgaagaatagccgcaacctgtttctggtgtgccgggcggagcataaaagaagcgtcgtgaaaggcttgctgcgccagcagggtcagggcttctggttccactttcaggatggtttcgccgtcgaagtcggcaacgctaacgtaatcggaagtgagtagatagtattcggtattgtctttccccatcgggaaaggtgcctggtagataaagggtttgtttgacatagcttccagcctgtaactctgtatttgttattcgaaaatggcgtgccgcgtagtcacgggcggcacgcaaagtgcatttataagaacccgtacatcgcggcgaagatccagccgaagacgcacgatacgctcacaccaatcaaccccggcagaataaagctgtggttgatgacgaagcgaccgatgtgggtggtgccggaacggtcaaactgaatcgctgccagatcgctcggataagtcggcaggatgtaataaccgtagcaagccggtgctgaagccacgatgtatgccggatcaacgccgatcgccagcgcgaccggaacaatcgccgccagcgccgcagcctgagagtttacaaacttggaaaccagcagcagaacaatggcataggcccacggatactctttcaccatttcacccagtacgccctgaatttcagacatatgcgcaccgaacatggtttctgccatccatgcgataccgtacaccgccacgatggcgatcataccggaacggaagacttcgttttttgagatagacgcgggattggttttggtcaggataataatcagcgccccggtcagcagcataaacatctgaataaccagtaccatcgacagcggtttgccgccgaaggatggacgcaggtccgaatcagcaccaagaagggcgactacagcgattgccccgaggaaaatccacattgccagccagttgcttttcggcagttttttatccagcagcgtcgcggtatcaccgtaaacatactcacggttttccggtacggagatgaatttctggaactcttcgtctttatccagatctttaccgcggaaccagctgaagataccgatcgccaggataccgattaacgtcgatggaatggtgattgccagcagatcgaggaactcaagatggcgaccatcaaaggtgacattacccagcatcgcaaccagagacacgaccgcaaccgacaccggactggcgataatccccatctgtgcaccgatagaacttgccgccatcggacgttccggacggatgttgttcttaatggcgacgtcgtagatgatcggcagaatggtgtaaaccacatgacccgtaccgcaaagaatggtcagtgtacaggtcacaaacggcgcgacaattgagacatatttcgggttgcggcgcagcagcttctcggcaatttgcagcatgacatcaagaccgcccgaagcttgcaaggtcgccgatgccgccaccaccgcaatgataaccagcatgacatcaactggtggtttacctggctgaaggtggaagacgaagaccagaatgaccagaccgataccgcctaataaacccagcgcgataccaccctttctggcaccataaaacagacatatcagtattatgataagttggatagtaaataacatgtgtgaaccctcgcgataatcctatttaaatttttgctgaatagatcacagtcacgttctgttttgtatgaactgttttcagagcctgactaaatatccgtttggtcgttaccggctttagcaaatacctcacagtgaatattggctgattaaagcagcggcaaatttatgcactgtgataagcggctttttcagagagaaagactctctggcgatgggtttatagtttgtactgcgcagatgttaatgttttgtttgctgttatcttattgatatttatcggtctattttttgttctcagggcagatgtcattaggtttatagattaatctgatctacccatttgtgggtaaaaatacacataatgcgggtgacataatagttaattaacttttgttagcgttttgaaattaaaaacaccgttcacctgaagagatattaatttttagcgatgatggagggataattatatttgatctggcacaagttttactgatgaaggatgtaacttgtgccaggggtattttgcattacggtaataattattacttacagataaccagcgatccgttattggcaatattgtttcagtagtgagtagtgttctgcctgaatacggtaacggtaaactggacgccccgtgacgccataatggatactggtgaacaagatgtggcagttgaccagccagatgaggtatttacggcaggaaacacgcgaaatgttaacctcgttggctagctcgtcggttgaaaattcatagtcctgatgcgcgtcaatccactggcacagtgtgcgtaacgtctgcggcgttaagccttttggcaagcgacgaggatcctgttcgttggagctgctgccgtggattagctgatcaagctcggcctggtcataatactgatgtttttccagcgccattttcttttgccgccagccggtgagcgcctcttcaaagcgggaagcctggaagggtttgatcaggtaatccacgacaccgtaatgcagcgaatctttaatggttgccgcatcggctgcggaggagatgacaatcacatcacttttgcaacgcgcgttatgcaggacaggcagtaaatcgagcccgttctctttttgcatatagatatcgagcaatatcaggtcgataggcgtatcgctattgaagataatctctttggctttctccagcgtcgaggctgttccacagcattgaaagcctgggatttgtgctacgtatcggcgattcagctccgcgaccattgcgtcgtcatcgataattaatacattgatcatctgttcgacctctccccgtcccagggtatctggacaaaaaattgtgtgaaaatcccgggttccgattccacggcgatgctgccgccgagattttctacctgttgtttgacaagtgctaaaccgacgcctcgctcgcttccttttgtcgagacacctttgtcaaaaatgtgatcgattttatcgggtgcgatccccggtccatcatcattaacttcacagtgcagccagccgtgacggtagtgcaatgttacgctaatttcgcctccgggttccggccctaatgcctccagcgcgttttctatcagatttcccaacgtggtaatcagcgtcgcgacctggtcctcactgccgctgtctggcagctggctttcactgtttaaaatcagcgtatggcctaaatcggtcgcgcggttaatcttgctgattaaaaaaccagcgataaccggagatttgatcttacccagcagagagccaatctcttcctgatagttattggctgttttgagaatgtaatcttccaactgcttataactcttcagatgcaataatccgagaatcacatgcaatttattcataaattcgtgggatcgttcacgaagtgcgtcagcatagttgaccagaccgtcgagtcgctgcatcagtttacgtacttcagttttgtccctgaaggttgaaatggcaccgatgataacgccattactgcgcaccggaacggtgttgatcagtaatagccggtctttaatcgtaatctcttcgtcgcggcgcggggtaccgtcgcgtaacacttccgagacatctaccacctgtgaccatgagtggcttagcgtcgacagtttctcatcgtcctgcgacttacggtaattcagcaattcttgtgcggcatcgttgatcagcgtgacctcgccgcgatcgtccacggcaacgacgccttctttgatagactgcaacatggcctggcgttgctcaaacagcgtggagatttcgtagggttccaggccgaaaaggatttttttcagtaccttaaccagaatgcaggtgccaatcagtccgaccagcatgccaaataataccgaccagataatgctccagcgactgtcattgatctgttgggtcacacggcttaactcaaggccgatcgccaccacgccaatttgtttatgattttcatcgtagatgggggtaaatacgcgtaaagcctgcgccagaaaaccgcgattgatagcgacattttcttcgccattcagcgctttaaggatgtcatcacctttaaatggctgaccaatacgctgggcttcaggatgcgagtagcgaagactttgcatatcggtaacgacaataaacagcagatcgttgcgtttgcgtacggcttccgcgatggcctggatgccactctcctgcggttttttctgcaagccctgacggatttccggcgagtcggcgagggtacgcgccactgccagtgccttgttggctagcccatctcgcgtcatatcactgatttgcgagaagtaaatcagatgcaccaccaatagcaccgagaacagtaccgcactgaccattaagatcactgtggtactcaatttcatcggacgtttgcgtaacatgcggtagggcaatgaatgtctcatcagcttccttgtgtgacaaatttcttaagcattatctctgatgaggcgggtaattcaaagggagtaagaatgattggctatataggggaagagactctggcaacggaaactgccagtgctgtatgaagattccggggctatgcttatagcgataatcatactgatgagagagggaaggtcatggatcaggcgctactggacgggggttatcgctgttataccggcgaaaagatcgatgtctatttcaacactgcgatatgtcagcattctggcaattgcgtacgtggcaacggcaagttatttaatctcaaacgaaagccgtggatcatgccggatgaagtcgacgtcgccactgtggttaaagtgattgatacgtgcccgagcggcgcgctgaaataccgtcataaataagcgagggtaaaatggaaatacgcgaaggccacaataaattttacattaatgacaaacaaggcaagcaaatcgctgaaattgtctttgtgccgaccggagagaatttagcgattatcgaacataccgatgtcgatgaaagcctgaaagggcaagggattggtaaacagctggttgcgaaagtcgtggaaaaaatgcgtcgggaaaaacgaaaaattatcccattatgcccatttgcgaaacatgaatttgataaaacgcgggagtatgatgatattcgcagttgatgggagagtacagagtcacgatatttttcattctctccgcgatgtgatgcaggagagcatctgaagggtagggggatgcacaaagaatgggcagagagcgcgtttttttgtcccaagtcatcccctttactgagcaaaaaaaagaatatctcctatatgagaatcatcaatcggggttaataagttttgcgtccccagagcgtttaatattgataggagtcatattatggaaggtaaaaacaagttcaatacttatgttgtttcttttgattatccatcatcttattcctcagtgttcttaagattaagatcattgatgtatgatatgaatttctcctctatcgtggctgatgaatatgggataccacgacaattgaatgaaaactccttcgcaataacgacatcgttagccgcaagtgaaatcgaagatttaatcaggctcaaatgcttagacttaccggatattgattttgacctcaacattatgacagttgatgactatttccgtcagttttacaagtagccaggaaggataagaagaacataaaaaatggcactattctctaaaatattaattttttatgtgattggtgtgaacatatcctttgtcattatctggtttatctcacatgagaaaacacatattcgtttacttagtgcattcctggtcggaataacctggccaatgagtctgcctgtggcattacttttttctctcttttaggagctgtagttgagtggacccgctggttatcgtgaaacgaagcgtctctcctcaaaactggatttgcggaacgatgaacgaagcagtcgcctgactgcttcgttcattaaagtgaaatttatttctgtgggcgcatcgccgggaagagaataacgtcgcgaatagtatggctgttagtaaacagcataatcattcggtcgataccaatacccagaccagcggttggcggcagaccatattccagcgcagtcacgtaatcttcgtcatagaacatggcttcgtcgtcacctgcagctttagcattaacctgttcctggaaacgttcagcctgatcttctgcgtcgtttaattcgctaaaaccattaccgatttcacgaccaccgatgaagaattcaaaacggtcggtgatttccgggttaacatcattacggcgtgccagcggggacacttctgccggatattccgtaataaaggttggctgaatcagatgtgcttctgccacttcatcaaagatctctgtgacaatacgtcccaacccccagcttttctctaccgtaataccgatagattcagctaatgctttagcagcatcaaaattatccaggtcggccatatcggtttctggacgatattttttgattgcttcgcgcatggtgagtttttcaaacggtttgccgaaatcaaacacatgctcgccataagtgactttagtggtacccagaacctcttgtgccagggtgcggaacagtgactctgtcagttcaatcaaatcgtggtaatccgcatacgccatgtagagttccatcattgtgaactcaggattatggcgaacagaaataccttcattacggaagttacggttgatttcgaatacccgttcaaaaccgcctacaaccagacgtttcagatacagctccggcgcgatacgcagatacatatctaaatccagagcattatgatgggtaataaacgggcgagcagatgccccacctggaattacctgcatcatcggggtttctacttccataaagccgcgcgcgaccatgaattgacggatagcggccagaatttttgaacggacaacaaacgtttgacgggatttatcgttagcgatgaggtccagataacgttgacgataacggacttcctgatcctgcagaccatggaatttatctggtaaaggacgtagtgctttagtcagcaggcgcagctcagtacagtgaatggaaagctcacccgtttgcgtcttaaacagcgtaccgcgggcaccgataatgtcacccagatcccattttttaaactgatcgttataaacaccttctggcaggctatctcttgcaacgtacagttgaatacggccaccgacatcctgcaacgttacaaaggaggctttccccatgatacgacgggtcatcattcggccagcaaccgagacttcaatgtttaaggattccagttcctggttatccttcgcatcaaactcttcgtgcaactggtcagaggtatggtcgcggcgaaaatcattgggaaacgccacaccttgctgacgtagtgccgccagtttttcgcggcgatttctcagttcatcgttaaaatcaatagcctcattggctccccgtgtttcttgttcagacattttggttcctctaaatccagctttcaatttagcgtagataaagagacagatcggtacactgtattatctgcctcgactattagtaactcagtttatcttatcgaaactaacgcttacctcaagttgatatcactaataaataaccatcaaaatggtttaaatgacttattaatctcgatttgttagtgttataaactgaaagttaatttattcataaccaattgtttttacgacagttaatcgttgctctcctgtatcatattcgtcggcgtgctaaacagaaaacgggtagcaaaggccaatacgacgatgatcgcgacacaagccaacgtccactctcccatctgagaaaagaatcgctggtaagctgcaattgccataccgctaatttgcgactctgtcgtctgctgtgccacgacgcctgccagccagttggcgaccgcgcctgttgccagcatataaatcccggttaatacgccagacattttcagacgcgtgatttgcgcaatcgccaccgggtcaataaagagttcggcaaagcccattagcgccagcccggatatcatcacgcccattgacgcttgaccgtcagccgctgcatgtcgggcatcaaatgccaacaacataaagccacaagccatcagcagtaagccaaaggcaaacttcagccagacgcgcaatgttgagttgccgcggctttctggcgacgccagccaggccagtacaaccccagcgagcatcaccgcaattgcattcaccgactggaatagtgctgtaggtacttcaatattgaatgcctgacgattcacaaagcgatcgataaacaagctgatggtactgccgccctgttgtgccagtacccagaacaatgtcccgacaaacatcaacaatacaatttgccaaagagcacggcgatgttcggggaatttgatcatcatgcgggcaatgatttgtgcggcaatgaggcaaacgatcgccagcaaatatccggaccagtcgttctccagcagcagagtaaaaaatactggggctaaacagagcatcaccactaaccagctccatactggtaaggcaaatttgacactagtgagcgcttttttatccatactacgtgtggactggaaatgacgatgaccgcttaagaaaatcaacaaaccgataaacatgccgccacccgcaagggcaaagccaacatgccatccataccactgagcagccaggccgcaggcgattggggctgcgatagaaccgatattgcccgcagcatacagcagcgaaaaaccgccatcacgtcgatgatcgttctcgtcgtagagctcgccaagcaaacagctgatgtttgatttgaataaaccgtagccacaaataatgattgccagcgccagatacaggctaaaggttgaatttgtatcaatacccagcaccacatggccaagggtcattaacagcgcgccggcaatcactgcagtgcggttgccgagcaggcggtcggcaagccagccgccgagaataggggtaacgtaaaccagagaagcatatgcgctgaacaggctgatggcatggttatcatcaaaaccaagctgatgggtgagatagagaatgagtaaggcacgcatgccgtaaaaactgaagtactcccagatttggatcgccacgatatagtatatcgcgcgcggctgtgagggtgttttcatgtgttctccttatgagcaaaaaagggaagtggcaagccacttcccttgtacgagctaattattttttgctttcttctttcaataccttaacggtatagcggccatcagcctgacggtatgcaccgtgaatatcggtttcaaagcccggatagtgagcgccgatttcacacagcatctgcaggaactccagaaccggacggctttcttcggtgatcatttcacccggcattaccagaggaactcccggcgggtacggaaggatcatattggcgttaatacgacctaccatttcgtcgaggtaaacttcttcggtcataccgtgcagctctttctggaatgcagcatacggagtcattaccatcgtcggcagcacttcaaatgcgcgatacatcagatccggcagattgtggtgaacaatcagtttgtggatattctgagccagttcctgaatacgcatgttttcatagaattcaggatcttcacgatacagagacggcagcatgtttttcacacgcaggttcaggtcgaacgcacgtttaaagtcagtcagagcacgcagcaggctcagtgctttggtcttatcgataccgatgctgaacaggaacagcaggttatacggaccggttttctcaacaacgatgccatgttcgtcgaggtatttcgccacgatgctggccggaataccaaagtcgctcatggtgccgtctttttccatccccggagtcagcagggtgactttgatcgggtcaagatacatgtgctcgttatcgatgtttttgaagccgtgccaggtgctgtcagaacgcagcggccagcattcagtcgtatcgatatgatccggctgccatacatcaaagaaccagccatcagattccgttctcagacgtttgatctctttacggaatttgatcgcacgttcaatagaaccgttgatcagacgcttacctgcattgcctttcatcatcgccgcagcggtttcagtggacgccacgataccgtagtgcggagaagtggtggtgtgcatcatgtaggcttcgttaaaggtttcttcgtttacgtcacctttaacgtggatcatggaagcctgagagaacgccgccagcagtttgtgagtggactgggtttcgtaaatcactttcccttctacacggccaccgctcataccgcatttaccttcgtaaatcggtgagaagttggtgtaaggcacccacgcggagtcaaagtggatggatttcacatccagtgttttcttgatgaagtcggtgttgtacagcagaccatcataggtagagttggtaattacagcatgtaccggccaggttgcgtttggtgtttctttcacgcgcttagcaatggtagcgtgctggaattcactctgtgggataccaccaagaataccgtaagcgttacgggtcgggcggaaatagattggcgtaacatcgctcatcatcatcaggtgggtcagcgatttgtggcagttacggtcaatcagaatggtgctgcctgctggagcagagtacataccaacaattttgttcgcagtggaagtaccgttggtcaccatgtagctgcggtctgcgttaaagacgcgagcgatatactgttctgcttctttgtgtggaccactgtgatccagcagagaacccagttcagatactgaaatggaaatatcagatttcatggtattcggaccaaagaaatcatagaacaggctacctaccgggcttttctggaatgcagtaccgcccatgtgaccaggagtacagaaagtatatttaccttcacgaacatatttaaacagtgctttagtcagcggaggcagaatagtgttgatatattcgtcagtggtctgcttgatcttattagcaatatcttcagcagcacccagcgcatattcaaagaagctaatctgtaaacgcaggtcattcaggcttacatcgagagtggaatacgtattagcgaacgcgtacaacggcaggttctcgttcattttgctaatttcttcgcacagctcgagattatatttatcccagtcaaaaataacgccgcacagacgcgcattgttttcgatcagttttaataagtcgtcacggtcgttcgggtaaacaatctggaagttcagacgttcaagcgcgcgatgaagttcacggatgggttcttctttaaaataaacccccatgtgattcaatattgcaataacgttcatagtcatatctccaggtaaaaaaggcccctcccaacacatgggacaaaatgaaaggaggagcctcggaaaatacttttaattaatgtgcgttagacgcggtgtggttatccattgagtggctctggcgctcgtgcattttgcgagcgtagaacatcaggataatcaggctgacgatgaaggtacctgccagctcgaaggagcttgcgcccatcagcgcgatgaagcagaacacgcaacccagtacagagcagatcaggctgacaaagttgcggatgttaacgccttcaaaacgaatcaggtcaacgcaagagtagaaatacggcagcatagtcagcagtactgcgataccggtcagttcaccgaacaggtcagatgctttaccaccggcagagttcatcagagtgataaggatcatcagggcagtcattttcactgcagccagcagcagaccttttttcggaataccgttgctgtcgacttcaccataaactttcgggaagttaccgtcgttagcggcacgtacacctgcctggcctaccaacatcatccaggagcccagagaagtcaggcacgcaaaggcggtgaatgcagaaaccagcggcgcagcccagttaccgaggatagttgaagcactgattgcaaacggagcaccggaagccgccattacagaagacggatacataccggaaagcacctgagtcgcagcgatgtaaacaatacctgctaaaccagtacccagcatggttgccagcggaacggtacgtttcgggtttttaaccataccagtacttacagctgcggattcaacacccacgaaggcccacaggcagagcagaatacttttaatgatcgcatgaccatcagtggtatccgcagtattccagttagctgcataagttgccgcatcaaaccaatgccagccaacaatagcagtcatcaccacaggaataagaaccagcaccagaccaatagtggttaaacggcttacccaagtaccgccgagcatatttacaaaggtaaatacccagacgatagcaatacaggcgatacccgccggaacaggatcatttaatactgggaagaaggtggaaagataagatacagcggtaataccaatcgccaggttaccaatccagttagcatggtaataaagaacacctgtctgaaaaccaaatgcaggggaaatttctccggcataagcaattgggccaccttgttgcgggttttttgttgccagtcgggcatatacatacgccagcgacattgcaccaataatagagataatccaaccccagatagcaataccaccgatacttgctaggttcgcaggtaataatgcaataccgctccccatcatattaccggcaacaacaccggtacaggcaaatagcccgatcttcttggcagaactcatgctcttctcctaatttcatttttgaatttggagtccgggtcatgatgtataactatttcctgaccagaccaaactggcgataagattactcacgaaaaaaggattaatcctaaagattaggtgaaataacacaaaagtttctgtaagtgagaacttgaggttttttattaacacatcaggatcgcaagttgatatcatgaaaagataaacatttaatgtttacaatggattgcgtgacattctctggttaaatttatgtaataaaaattatgcggcaaataaattgccgcaacatattataccaacaggaacatacaaaaactcaacaacaaatatttccgagcataaatcaacccggagttacttattctgaagcaagaaatttgtcgagataaggtacaacataaggaacagaagtctggaatataccattttcaatccagtaaagggtgtttgcccctgggcgtaaattaaaggcggtgagatatgcatcagctgcttcccggttcatccccttcatttcataaaccttgccaagcaacacataatttagccaggacatttcaagatcaatgccagtatttatcgcctggtaagactcatctgttttaccttttaccagagcactgaccgcttttatttgatatataatggacaggttgttcaattccggcagtgtaacaatgttatctatttctgtgttcagtgctgctaattgtttttcatctaaaggatgttgagaatggcgcacgatatcaactaatgctttttctgctctcgcgtaggtaaattctggggatgattgaacaatctcacctaataattcactggcacggttcaatgatttatcatcgccatgcagtaaataatcatgtgcctgataaaaattagttaataacgcaccacgatgcggcaaaattttctggagcgtctcctgcattcgttgtggccacggttggtttaacgcttttgataaactctccagtaaatcattttgaatcgccagctgattaccgttagtgatgacataacgtttatccagcatggttgaaccatctgcattgtctaccaattttatcgacataaagcattgttgagcacggtattggcgctgattaacaaacgcaatagataatgttttaccggaactgctcggttcatcaatgttgtagttgattttgtcatgcaccataaaggtggagaaggtgttaagtgatgtcgccaccaaatcacccacgcctatcgcgtaagagagctgatacggggaactccagctgttacaacttttatttaccatattaatgtcaatatcgcgtggattgagcaaaatacgcgatttgctcataggaagacgtgtatcaagacttgaaaacgctaccagtgctacacagatacctaacgacaacaggaaaaaaaaccatacccaaaaggtagtgaatcgtttgcttttaactggggattgttcaggtggcgttgcggtgttttgaatgttaagactgtgggagggagaatctgtggcaggaaccgcctctggtatagggggaggcgaagatagcattatttcctctccctcttcttcgctgtaccagataaccggcaccattaatttatagccgcgctttggtacagtagcgatatagacaggactatcttcatcattatcttttaatgacttacgtagttctgagatactctgcgtcacaacgtgattggtgacaatacttctcttccagacattatcgataagttcatccctgctaagtacttcgccactgtgttgagcaaagaaaaccagaagatcgattaatctcggctcaagggtaagttgacgcccattgcggctaatttggtttatggacggagtaacaagccattcgccaacgcgaactacaggttgttgcataatagaaactcattcgaaaagggaatgatgcaatgataattgccacaacctatttttaccatctatagatgggtttatttacatattattggtgaatgcaagacgttatttttaccagccataaacttcttgattacatagtattacgaaaggattttactgagaaccagaagtaatattccttaccatcaaaattcatcatctttgccaaagaaaaatgttcagaaaataatccatggaaaattgtccggagcacttactattttaatggattgttagtctttgcatgagcaagcgaactgatacatttctctttgttctcattcagaaaatctcatcagtcgccgttcagaccggtgttgtgctttatggatgcgttacgctcctgatgacgtcatttgacgttcaacagcatcacggggccgcacgacatttcacgtcagttagtgctatagctcaggaacaaattttcccgaattgggatatgcccgcaaattgctggtgatgtggggagaatctggttgagttcggtagaattgatttggaggcagaacgcttaaatcgtggcgtcctgaaacgaaaaacggacctccgtggaggtccgtttatatgaatttggtgcccggactcggaatcgaaccaaggacacggggattttcaatcccctgctctaccgactgagctatccgggcaacggggcgcattaaaccgtaatctgcacatctcgtcaacctaatttcagtaaaagcgattcaactgcttaagattgcggcaaatcgcttcttttctgtgtttctgtcaggtcaatgcaccaccctggcggcagcgggcgaagcgcaggatatcttccgccagccgatgtgcagtgtcgacatccgcctggctacgattcaccagcattcggcttaaacagccttccagcaccagttccatctgctttgctaccatcgccggatcgtcaacttccagtgtggttaacagttcgtgggtgaaatcgtaggccgcgcttttttgctgatcggccagttgatgaatagggtggccaggatcgggataaaacgtacaggcagcgataaatagacagcccggatagcggttgtttttaacgcactccgataacgcctgataacgtgccagcagcttttgttcggcggtttgcgtttcgtccagcatcagctgacgacgccagacatctatctgttggctaagataacgcagcgcatcgtagaggattgcctctttgtctggccagaagcggcgtagctcgtccagtggataatccacacgttcagcaaccatctccagcgtggtgttggcaatcccttgtaattctaataatttcagggcttctcccagtacatcttcacgttgcacgctattttcctccgtctttcccactgcaagtgtcgttcacggttggcgatcgcgcaaatgtgcgctgaaggtttcagcatccataaagcccgtgacgcgtgcttgtggatgctcctggccttgtccgtcaaaaaagagaattgtcggtaggccaaggacattaagatgctttaacagcgccacatcttgtgcgtcgttggccgtgacgttggcctgaagtaagaccgtgtctgctaacgctttttgcacctgcgggtcgctgaaggtgtatttctcaaactctttacaggcgacgcaccagtcggcataaagatctaacatcaccggtttgcctttggcttcaacgagcgcctgatttaactcatctaccgttttgatttgtgtaaagttgagatgcgtctgagtttgcgcggtatgcgtcgcaccaaatgcccaatcctgaagtgggcgcacgctaaccaatgccgctgccagcagaataatttgcacaatacgcatccagccgcgtttagcctgtaggctggtgataaaggcccagccaaagaatgcgacacccagcgccgaccacaagcgtaatccccatacatcaccaatcactcgctccagcaggaagaccggcagtgcgaggatcacaaaaccaaacgcggttttgacttgttccatccacgggccgcttttcggcagcaagcggttaccaaagacggtaattagcatcagcggcaggcccatgcccaacgcatagagataaagcgtgccgccgcccagccacatgttcccgctttgggcgatatacagcagaatcgcgctaagcggtgcggtggtgcatggtgaacagatcagtccggcaatcgcccccataacaaacacaccgccaggtgagccgccctgttggcgattgctcatcaacgtgagacgtgtttgcagcgaagaggggagttgcagggtaaacaagccaaacattgacatcgccagcaaggtaaagacgatggcgaggccaatgagcacgtatgggtgctgtagcgccgcctggaactgtaaccctgcggcggcaaccaccagacccagcgccgtgtaggtcagcgccatcccctgcacataaataaaggtcagcaacaatgctctggcagtggagagccgctgtttaccacccagcacgatgccagaaatcagtgggtacattggcagcacgcatggcgtaaaggcgataccaataccgatcaacaacgcccagagcgcggaaaagggcaattgcgcggtgggctgctcttgctgcggaacagacacaggctgtggcgctgcgttgttggcgaccacttcgcttaacggaacggttttggtttctggcggataacagaaaccggcatcagcacagccctggtaggtgacagttaacgtcgctcccgcactcgcctggttgatggtgacgggaagcgtcagccgatcgcggtaaatctcgcttttgccgtaaaactcatcttcatgccagacgccttgcggcagctgcacgtcggcaattttcgcgtgttccggcgtaatgcggatctgtttacggtagaggtagtaaccgtctttgatctgccaggtcagattaaggtcatgttggttttgctgaaaatcaaaagcaaaggcttgatccgcggggacaaattgtgaacgtcccggcgcgtcgaataatccggcaaaaacggaagtgctgcaaagtagcaggatcagcgtaaagatgcgttgagccatgagaggtaatctgtgtctccgtgtgtaacaggtaaaaccagaagttccggggtttgatatggatgatgagacttcaggcattccagcagtgcctgctggtgagatacggtagtttttaaaatcatctgcacttcgtattcttgctccagcttaccttcccagtaatagagagaggtagcgccggggatcaaggtcgcgcaggccgccagtttttccgccagcactttggcggctaaatcctgggctgtcgcttcatctggtgccgtacatagcaccacgacagacgcggtattcgaacttttttcatcaagcataaacacctcgcaagaacagatggaaccgcaagagagaggtcactatacaacggacgggggaaggatgttagtcggcgggaaagaaagcggggcgtgaacgccccgcgattgatcattacagcatgaagctacccagcacgaagccgaagcaaacggccagggcaacacccagagtacccgggatgaagaacggatggttgaagacgaatttaccgatacgggtagtacccgtgtcatccatctgtaccgcagcaaccagcgtcgggtaggtcggcagaatgaacagaccagacaccgcagcgaaagaagcaacagcggtcagcggtgaaacgttcagtgccagagccatcggcatcagtgcttttgcggttgcagcctgagagtacagcagagcagaagcaaagaagaagatgacggccagcagccacggatgaccctgaatcacttcaccagcggtatctttgatccagtcgatgttgttggaaacgaaagtatcgcccagccacgcaacacccaggatacaaatacaggcgctcatacctgctttgaaggtgctggagttgaggatgttgtcggtatcgactttacagataacggtggtcagagttgcaacgctgagcatgatgatcaggattgcgttggtggtgttcatcagcggtttttcaaccagacccatgcttgggctgttgatgattgcatagataaccacgccaactacgcccagcaggaacagccagacggacgtttttgcaccggatttgatttcaatctgcttttcaccgcgcagttcaaccaggccctcttccagacgcttgcgataaatcggatcgtcagagagtttggagttgaacagcatagtgaccaggaaggacatcaccagaaccgccagcagggtggacgggatgaccacggagagcagatggaggtagctgatgccatgaccttccatcacggaagacatgtaaaccactgccgctgagattggcgatgcggtgatcgcaatctgcgcggataccactgcagtagacagcggacggcaaggtttaacgccttgttccttcgcaacttcagcgataactggcagtgtcgccagagagatgttgccagtaccagcaaagatagtcaggaaataggtcacgatcggtgcgaggatcgtgatgtatttcgggttacggcgcagcagcttttctgtctgatgaaccagatagtccagaccgccagcaacctgcatggcagaaatagcggcgataaccgccatgataatggagatgacatcgaacgggatgttaccgggtttaacgccaatagcggcaagaaccagcacccccaatccgcctgcaaaaccaatacctattccccccaatctggcgcccaagaagatcgccagcaaaactatgatgagttctacaactagcatattagccttccttgttttttaacaagttgatattagattgttatttttaagttactgctcacaagaaaaaaggcacgtcatctgacgtgccttttttatttgtactaccctgtacgattactgttcgctttcatcagtatagcgttttgctttgtaagccgggtgcatcagattctgtacggagaaaatatcgtcaagttccgcttcagtcaacagaccgcgttccagaacgacttcacgtacactcttaccggtttcggcacagattttacccacgatgtcaccgttgtggtgaccgatgaacgggttcaggtaagtaacgataccgatagagttgtaaacgtaaccttcgcacacttctttgttagcagtgatgccgttaatgcatttttccagcaggttgtagcaagcgttggtcagaatgtgaacggattcgaacatggcctggccaatgaccggctccataacgttcaactgcagctgacctgcttctgctgccatggtaacagtggtgtcgttaccgatgactttgaagcatacctggttaaccacttccggaacaaccgggtttactttagctggcatgatggaagagcccgcctgcagttccggcaggttgatctcgttcaggccggcacgtgggcctgaagagagcaagcgcaggtcgttacagattttggacatcttcacagccaggcgtttcagcgcgccgtgaaccataacataagcgccgcagtcagaggtcgcttcgatcaggtcttcagccggtacgcatgggaagccagtaacttcagccagttttttcactgccagcggagagtactctttcggcgtgttcagaccagtaccgattgctgttgcaccaaggttaacttccagcagcagttcagcggtacgttggatgtttttcacttcttctttcagcaggatgctgaaagcgcggaattcctgaccgagggtcatcggtactgcgtcctgcagctgggtacgacccattttcaggatgtcctggaattcgacagctttacgttcaaagccttcacgcagttggttaatcgcatctaccagcttaatcagggaagagtaaactgcgatacggaaaccggtcgggtaggcgtcgttagtggactgacatttgttaacatggtcgttcgggttcaggtactgatattcacctttttggtgacccatcagttccagaccgatattggccagcacttcgttggtgttcatgtttacggaagtacctgcgccgccctggtagacgtctaccgggaactgatccatgcattttccgttgttcaggacttcatcacatgcggcaatgatggcattcgctacacttttaggaatggtttgcagctctttgtttgccatagctgcggcttttttaaccattaccataccgcgaacaaattcaggaatatcactgattttgttgttgctgatatagaagttttcaatcgctctcagagtgtgaacaccatagtaggcatcagctggaacttccctggtacccaacagatcttcttcgatacgaatgttgtttgacatgtgaaccttctttttcaagctgccaatgatttgctttaaacacacagaatatatgtggtttcgaatgtttttcgaccgacgattatcccctgcatcgaccgaatacccgagatcatatgctgcttgaggatttctaccgtaatctggatcactttaagtgtcggtttttaccccttaattattaatttgtgaaatagatcaccgctttgggattactaccaaaaatagttgcgcaaacatcttgaaattttgctaatgaccacaatataagctaaacgcgattcgcaacccattcaggtagccggggttaaccggctgctattacaggagaaacctttgcgctggttaccttttattgccattttcctttatgtctatattgagatttcaatctttattcaggttgcccatgtattgggggtattgctgaccctcgtgctggttatattcacgtcagttatcggtatgtcactggtacgtaaccagggctttaagaatttcgtgctgatgcagcaaaaaatggcggcgggtgaaaacccagcggcggagatgattaaaagtgtttcgctgatcattgctggtttgctgcttttattaccgggcttttttaccgacttcctcggtcttctacttttattgccgccggtgcaaaagcatctgacagtgaagttgatgccgcatttgcgcttttctcgcatgcctggcggcggttttagcgccgggaccggtggcggtaatacttttgatggtgagtaccagcgaaaggatgatgagcgcgaccgccttgatcataaagacgatcgccaggattaatgtcgaaacgccggattatgtggttatgccattttccggcgtttttcgttttggcagcaacagccataaccccgccagcatgatcagcgcatagagacttttccagccgaccattgccagtaacagaacgcataacagcccgccaaccaccgccagtagtcgataacgtccttgcaataatttacagcctgccagcatgcataacagataaatcataataaagatgccattggcataaataataagagcgtccagattgatctctaaagcatgaatcaccaaagtgctcaccacacagcagccgagcaccgcattgagggcattattcgggatatggcgagaagagaggcgtgccaggtagtggtcaggattatgttgcgcctgcgaccagaccaggcgggcgaagctctgtatataaatgttgagactggcaaagcaggccagatagccaatcacgcaggcaatccataacgctcctacaccgaacaactgcactacaatttttggaagcgatgctgccgccgccattttttcaccataggcgtcgaagtgtaagacgactaccgtacagccccagtagactaatcctgccagcagcagaccaatcatcaaagcacgaggaaaatcacgctctggatttttaaattccgaggcgagatgggcaaatgcctccagaccgacaaaacaccagaacatcactgataacgcagcaaataacccggtaagttcgatattaccaggtgccggaaaggggatattcgcaggtttgatatcgcccgcccaccagatagcgacaatcagcgcgacgataagtccggcaataacggtttgtagattagcactggaactggcaccgcgagtaccgatataccacaccagcgccagcgtaccgagttctgccaacaacagttgccagctatgccagccaaacatcgcctggccgaacccggcggcaatttgtagtgcggcaggcaaacccacgggaatgaccgataaaaacagccagccggtgactcgctcaagccgcgaaccaaacgccataccgacgaagtgcgcgacgccgcctgcgctgggatagtggcgacccagaatcgcaaacacaatcgcaatcgggaacactaagataatcaaaacgggccacgcccacaggctgttattgcccgctaccagcgcagctaacgcaggaacggcaaacacgccagtgcctaataatgacgtcgatagcaggccaatgccctgggccagccccagttcttgtttgagtccactcatgggttgatgtccgattgcgcccaaattttgggcaactgcgtagattttcgatggtagcacaatcagattcgcttatgacggcgatgaagaaattgcgatgaaatgtgaggtgaatcagggttttcacccgattttgtgctgatcagaattttttttctttttcccccttgaaggggcgaagcctcatccccatttctctggtcaccagccgggaaaccacgtaagctccggcgtcacccataacagatacggactttctcaaaggagagttatcaatgaatattcgtccattgcatgatcgcgtgatcgtcaagcgtaaagaagttgaaactaaatctgctggcggcatcgttctgaccggctctgcagcggctaaatccacccgcggcgaagtgctggctgtcggcaatggccgtatccttgaaaatggcgaagtgaagccgctggatgtgaaagttggcgacatcgttattttcaacgatggctacggtgtgaaatctgagaagatcgacaatgaagaagtgttgatcatgtccgaaagcgacattctggcaattgttgaagcgtaatccgcgcacgacactgaacatacgaatttaaggaataaagataatggcagctaaagacgtaaaattcggtaacgacgctcgtgtgaaaatgctgcgcggcgtaaacgtactggcagatgcagtgaaagttaccctcggtccaaaaggccgtaacgtagttctggataaatctttcggtgcaccgaccatcaccaaagatggtgtttccgttgctcgtgaaatcgaactggaagacaagttcgaaaatatgggtgcgcagatggtgaaagaagttgcctctaaagcaaacgacgctgcaggcgacggtaccaccactgcaaccgtactggctcaggctatcatcactgaaggtctgaaagctgttgctgcgggcatgaacccgatggacctgaaacgtggtatcgacaaagcggttaccgctgcagttgaagaactgaaagcgctgtccgtaccatgctctgactctaaagcgattgctcaggttggtaccatctccgctaactccgacgaaaccgtaggtaaactgatcgctgaagcgatggacaaagtcggtaaagaaggcgttatcaccgttgaagacggtaccggtctgcaggacgaactggacgtggttgaaggtatgcagttcgaccgtggctacctgtctccttacttcatcaacaagccggaaactggcgcagtagaactggaaagcccgttcatcctgctggctgacaagaaaatctccaacatccgcgaaatgctgccggttctggaagctgttgccaaagcaggcaaaccgctgctgatcatcgctgaagatgtagaaggcgaagcgctggcaactctggttgttaacaccatgcgtggcatcgtgaaagtcgctgcggttaaagcaccgggcttcggcgatcgtcgtaaagctatgctgcaggatatcgcaaccctgactggcggtaccgtgatctctgaagagatcggtatggagctggaaaaagcaaccctggaagacctgggtcaggctaaacgtgttgtgatcaacaaagacaccaccactatcatcgatggcgtgggtgaagaagctgcaatccagggccgtgttgctcagatccgtcagcagattgaagaagcaacttctgactacgaccgtgaaaaactgcaggaacgcgtagcgaaactggcaggcggcgttgcagttatcaaagtgggtgctgctaccgaagttgaaatgaaagagaaaaaagcacgcgttgaagatgccctgcacgcgacccgtgctgcggtagaagaaggcgtggttgctggtggtggtgttgcgctgatccgcgtagcgtctaaactggctgacctgcgtggtcagaacgaagaccagaacgtgggtatcaaagttgcactgcgtgcaatggaagctccgctgcgtcagatcgtattgaactgcggcgaagaaccgtctgttgttgctaacaccgttaaaggcggcgacggcaactacggttacaacgcagcaaccgaagaatacggcaacatgatcgacatgggtatcctggatccaaccaaagtaactcgttctgctctgcagtacgcagcttctgtggctggcctgatgatcaccaccgaatgcatggttaccgacctgccgaaaaacgatgcagctgacttaggcgctgctggcggtatgggcggcatgggtggcatgggcggcatgatgtaattgccctgcacctcgcagaaataaacaaacccccgggcagaaatgtctgggggtttttcttttggtcatctttctagtataagattcagacacggacgacgcgagtggcgtccagctcattgattatggggaataacatgcacgtaaaatacttagcagggattgtcggtgccgcgctactgatggcgggttgtagctccagcaacgaattgagtgctgccggtcagagtgtacgcattgtggacgagcagccaggcgcagagtgccagctgattggtactgcgacaggtaagcaaagcaactggctttccgggcaacacggagaagaaggcggttctatgcgcggcgcagcaaacgatctgcgcaaccaggcggctgcaatgggcggtaacgtgatttatggcatcagtagcccgtcgcagggaatgttgtccagttttgtcccgacggatagccagattatcggtcaggtttataagtgcccgaactgatgtgatccagaggctgggtgacaaacgtataattgcctgatgcgcttcgcttatcaggcctacataaggcattgcaactgattgaatgcttgagaatttgtaggccggataaggcgtttacgccgcatccggcatgaccaacgatcacgttatcagtcatttcaggctggatggctccagcctcgcattagcaaagatgagattatttcgcctgtggtgcagttttgctggtggattgaacacgtaagtgatgcagcgcgcgtaagcattgatcctgggttagcggttgggcgttattcgccgctacggtgcgaacatagacctgacatggcacacccgcgagttttttcagtcgtgggctgaaatcaagcattcggcgagtgatcgcttctatttctttacccggcgttgcttcacgcgttttcaccactgcgccgctaaattgttctttgccactttcatctttaaagcggtaaagcaccgccagataatggtcgaacaagttatgtttccattccggttgggaataggtgtcatattccagattgccattgtcctggcagtcaacgtcgtataacggcaggaaatctaacagtgaggtaatacgtaatgccagttcacgcatttccgcattattaattgcatgaatgattgctcgcgccagcatttcaatctgcaactcattgacgactaactcacatttgctaccgtcatgtagcgttaatacgaaggtaagattttcgccttgattatcggtaagttccagcgtgttaacccgacgattaatatcggcatttttaagctcatcaaccagaatttctgggatgttttctgccattttcttaatgactttatcgcgagcttgctcatactgaaggtgtgcagcagcatccagtttatgcttttgatgcagacgactttccagcgcaatcagcaggtcgcgcagttccatgacagacataaagaacaacgattctttattgcgaggttctttaattttcagcgccagtgcaatgaaattattactcttgcgaataacaccggtattaacacccttgatgcttatggccatgtaggttctccctaaccatttctcaattaaataattaattttaatttataagccagataaatgggcttggtagtaatagttgttaaaataacataaatagccgtactcactctatataaacagaaaagaaaggttaattattggtgttagctatataaaaagtaacaacagcaatgcatatgaataattaaaggttatgcaacgggcaaagattaaacttcccagtttaatgacaggttgctgtacttgcgtttgttgctcttgccggatgcagcgtaaacgccttatccggcctacagttcattgcaaatccattcaatttcaatgcacgatgtaggcctgataagcgtagcgaatcaggcaattttaatgtttaacttccctgtttaatcagttactgctggcgtagctggagatccagcggcgttttgctgggttcgccgccaatttctcgcgccagtttcggcaccagatatcccgacaccagtgtcagcaactcacgcataatctgccgtgcttcgtcatcactcaccataaaatgcgccgcgccctgtactttatcgagcacatgcaggtaatacggcattacgccggcatcgaacaacgcattactcaggtttgccagcgtttgtgcgttatcgttcacatcacgtaacagaacgctctggttcagcaaagtaacgcctacccggcgcaacttagccatcgcctgacggaatgtttcatctacctcattggcatggttgatgtgattcaccagcaagatttgcagcgtagaacgggcaaagcattcaaccagcgcctcggtgatacgtgccgggatcacaatcggcagacggctgtgaatccgcagacgttttatatgcgggatggcttccagttgtgtgagcaaccagtccagctcgtgatctttcgccatcagcggatcgccgccggagaaaatcatctcgtccagttccggatgcgcagcaacatactcaagtgcagtttgccagttacgcttgttgccctgattttcggcataggggaagtgacgacggaagcaatagcggcaatttaccgcgcagccgcctttgaccagcaaaagcgcccggttgtggtatttatgcaacaaaccaggcactacgctgtgctgttcttccagtgggtcggtggagaatccgggcgcgatgacaaactcatcttgcgaggtaagtacctgacgcaaaagaggatcgtccggattgcctttctccatgcgatcgataaatgagcggggcacacgcagggcaaaaagctttttggcgctgcgtccggctaacagtttttcctccgcgtctatattcaaaagacgcagaagttcatcaggatcggtcacaacatcggcaagttgcgttaaccaatcttctctggatggggtatttagggttacaatatgcgccattttgtggcttagctaccaattaacaaatttcagagggccttatggcaacgtactatagcaacgattttcgtgctggtcttaaaatcatgttagacggcgaaccttacgcggttgaagcgagtgaattcgtaaaaccgggtaaaggccaggcatttgctcgcgttaaactgcgtcgtctgctgaccggtactcgcgtagaaaaaaccttcaaatctactgattccgctgaaggcgctgatgttgtcgatatgaacctgacttacctgtacaacgacggtgagttctggcacttcatgaacaacgaaactttcgagcagctgtctgctgatgcaaaagcaattggtgacaacgctaaatggctgctggatcaggcagagtgtatcgtaactctgtggaatggtcagccgatctccgttactccgccgaacttcgttgaactggaaatcgttgataccgatccgggcctgaaaggtgataccgcaggtactggtggcaaaccggctaccctgtctactggcgctgtggttaaagttccgctgtttgtacaaatcggcgaagtcatcaaagtggatacccgctctggtgaatacgtctctcgcgtgaagtaatgcggttgtggtgcggcctgcaggctgcaccatcacttattcaggtcagagatgatgaaacgccttatcgttcttgttttgcttgccagcacgctgctcacgggctgtaacaccgctcgcggtttcggcgaagacatcaaacatctcggcaactccatctctcgcgctgccagctaatttttcttctcttccgaaaaatcatcagattcccatcatttttggcgatgttgtctattattaatttgctataggcaaacataaataacattacctaaaaggaagacgttatggtgaagaagacaattgcagcgatcttttctgttctggtgctttcaacagtattaactgcctgcaacaccacgcgtggcgttggtgaagacatttctgatggcggtaacgcgatttctggcgcagcaacgaaagcgcagcaataagcaataacggtacgacagctgtgtcgtgccgtttgttttttctgcgatagtcacaaaggtaatagttgaaattcccctgccacctggcaaaatatccgttcaaccatcagctttgcaggacgacctgcaaacgcctcttttcaccggggacggccccaattctccggagcctgatatgtcctggattatcttagttattgctggtctgctggaagtggtatgggccgttggcctgaaatatacccacggctttagtcgtttgacgccgagtgttattactgtgacggcgatgattgtcagtatggcgctacttgcctgggcgatgaaatcgttaccagtagggacggcttatgccgtgtggacgggtattggcgcagtcggcgcggccataaccggcattgtgctgctcggtgagtccgctaacccgatgcgcctggcgagtctggcgttaatcgtattggggattattggtctgaaactcagcactcactaactaccaggctgctgtacccaaataaatttactgacatcaaacccttcccgggtcgcgactgccagcatctcctgtttcacttcgtcagaaatggttggcgtgcgggagagtatccacaggtagtcgcggtccgggccgcaaaccagcgcatggcggtattcccgatcgagtgcaataacgttataaccgccatagaaaggaccaaagaatgacactttcagcgcagcgcgagttggtgcgccggtaaagtacgctttcccttcactctgctgccacattcctctgtcagggttatagcctttattaatgacattcaggccgccgtcatcacgcaggctgtatgttgcggtgactttttccagtccacgttcaaagcggtgatcaaaacgggcaatctcataccaggtaccgagataacgtttggcgtcgaaattatttactacggtcacgccacgcggcggcgtaggagaactgcaggcaacgaccagaaatgcagctgtcgctgcggcaacgagagggagcaggcgcataaatgtttccttactggtttttttctaagtgtagatgacagcaaggaaaagcggagaaaaggtccgaaaattcggacccgatggaattttactgtagagcgttaagaatctgccaggcggcgtcgactctcgctggattgggatagtttttgtttgccagcatcacgatacccagctctttttctggaataaacgcgacatagctaccaaatccgccggtcgcccctgttttatgtacccatgatgcgcgtactgcaggagttgggggcgtaatcgcttttacggggcgtgctgccagtgcaattttattgtcactgccgttaatgatgctgtcaggatttaccggccagtccagcatttcccagcccaggccctgatacatatcgccggtttgccagtagcgagattgtgccagttgtatcccttgttgaagcgttttctcattgatatcaaggggttttaaattgctttgcacccagcgggccatatcttcaatggtcgacttcacaccataagcttcagcatctaacgccccaggcgaaacatgcactgccttaccttcgcgatatccccaggcgtaattcttttcttctgcgggcggtacattaatccacgtatggttgagtttgagtggctggaagacacgagtttgcatcgcctgctcaaaactcaaaccagacggcttcacagccagtgcgccgaacaaaccgatactggagttggcatacagacgttgtgttcctggagcccatgcaggctgccagttttgatagaagcgcagcaagtcgcttgaggatttcacctcatccggcacctgcaatggcaggccgccagcagtgtaggttgcgagatgtaatagtgtgatcccattccactgtttagcggtaagttcaggccagtattttgttgtgggatcgcttaacttgatttcccctcgagcaatagcgtcgccaccaagcacgccagtaaatgttttgctgaccgaacctaactcaaacaacgtttgctgtgtgacgggctgctttttggcgatgtccgcatagccccaggtaaagtaataaggtttaccctgataaattaccgccaccgccatacccgggatcttttgttgctctataagcggggtaattgtgcgatgcacaatatcgttgatttgttgaggggcagcaaatgtggagcaagaggcggtaattaataaggcgcagagcgtcgttttgaacatagggtctggtttccatacaaaacggcccgccataggcgggccggatttacattggcgatgcgttagattgtaacgacaccaatcagcgtgacaactgtcaggatagcagccagaccgtagaaaacccatttgcccgcaggtacgtggattttcagatcgtgcatcgcgtggtgcatacggtgtaaaccacaccacagcggcagaacgatcatcaggaacaggaatacgcgaccaatgaagctctgcgcgaacgccagaacgcgctcgtagctcagcgcatcacccggaaacaaccccagtggcagcagaatacccaccagcaggatcatcaccggcgcaatgatggcgctccacataccaccggccccgaagaggccccagaataccggttcgtcagaacgctttggatttggattaatcatctcaggctccttaccagtacagggcaacaaacaggattacgatggtggcaaccacagttaccgcccagagacttttgataattggctctggtcccattttttcgtcttttacaatgatattggccgctttcggtgccagttcaaaccaggttttggtgtgcagcagagctgccgccagagtgatcaggttaatgatcacgataaccgggttttgtaaaaagtcgacgaatcccgcccaggcttccgggccatttttcagggcaaacagcccgaaaatcagttcaatgctgaaccacacagccggaaccgccgtgccttcgcgcagcatgtaaaagcgataaaacggcaattttttccaccaggtggacgtcattggccgtacatacggtttacgtttagtcgtcatgttgcactccttagcgtggtttcagggtcgcgataagaaagtctttcgaactttctactttgccctgctgaatggccgcagccggatcgacgtgtttcgggcagacttcggagcagtagcccacgaaagtacagctccatacgccgttctggctgttcaactgcgccatacgctccttcttaccgtggtcgcggctatcttcgttataacgatgcgccagcgtaatggcagccggaccgatgaactctgggttcaggccaaactgcgggcacgcggcgtagcacaaaccacagttgatgcaaccggagaactggtgatacttcgccatctgcgccggggtctggatgttagtaccctgatccgcggtgcgggagttgccgatgatgtacggtttgatcgcttccagactttcgatgaagtgggtcatatcgaccaccagatcgcgttcaatcgggaagttagctaacgcttcaaccttcataccgtcggtgtaatcacgcaggaaggttttacatgccagttttggcacgttgttaaccatcatgccgcaggaaccacaaatcgccatacggcaggaccagcggtagctcaggtccggtgccaggttgtctttgatgtagcccagcgcatccagtaatgaggtagttgcgtcataaggcacttcatagaatgcgctatgcggtgcggtatcgacttccgggttatagcgcaccacctcaattttcaggtttttcatctcagccattcgccttctccttcttattggctgcttccgccttatcggctgcatccgcttcgccaccgtaaacgcgtttagctggcggcagcgtagtaatcttcacgtcgctgtactccaggcgagtcgtgccatcagcatcgcggaaggcgagggtgtgtttgaggaagttgacgtcgtcacgctcggtgcaaccttcgtccagacgctggtgcgcgccgcgggactctttacgtgccattgcggagtgcgccatacattcagcaacgttcagaccgtggcccagttcaatggtgtagagcaggtcggtgttgaacacgctggaagtgtcggtgatgcgcacgcgcttgaagcgttcctgcagctctgccagcttgtcgatggttttctgcatcagttccggcgtacggtagataccgcagccttcttccatagccaggcccatttcgtcgcggatcttcgcccagttttcgccgccatcctggttaaccagatctttcagacgttgttcaacgccagctgcctgcgcttcaattgccgcttcgttgccattaccggcagttgctgcacgctctgtcgcttgttcaccggccagacggccgaagaccaccagttccgccagggagttagaacccagacggtttgcaccgtgcagaccaacagaggaacattcacccacggcgaacagacctttaatgcgggtttcacagttctgatcggtttcgataccgcccatggtgtagtgtgcggtcggacgtaccggaatcggttctttaaccggatcgacgccaacgtacgctttcgccagttcgcagatgaacggcagacgttcatgcagttttttctcgccgaggtgacgcaagtcgagataaaccacatcgccacgcggcgtggagatggtgttgcctttacgccattcgtgccagaaggcctgagagactttgtcgcgtggacccagttccatatatttgtttttcggctcgcccagcggagtttccgggcccatgccgtaatcttgcagataacggtagccatttttgttgaccagaataccgccttcaccgcggcaaccttcggtcatcaggataccggaacctggcagaccggttgggtgatactgaacgaattccatgtcacgcagcggaacgccgtggcttagcgccatacccataccgtcaccggtaacgatgccgccgttggtgttgtaacgataaacgcgacccgcaccgccagtagccataacgaccgcgttagcacggatctgcaccagcgtgccttccatcatgttcattgctaccaggccgcgaacatgaccatcatcaaccagaatatccagcacgaaatgttcgtcaaaacgctggatctgcgggaattgcagagaggtctggaacagcgtgtgcagcatatggaagccggtcttatcggcggcgaaccaggtgcgctcgattttcatgccgccgaagcgacgtacgttgacgctaccatccgggcgacggctccatgggcatccccacagttccagttgggtcatttcggttgggcagtggtggacgaaataatccacgacatcctgctcacacaaccagtcgccacccgctactgtatcgtgaaagtgatattcgaagctgtcatgatcctgcgcgacagcggcggagcccccttctgcagcaacggtatggctacgcatcgggtatacttttgagattagtgcgatttttgcattcggatttgcctgcgcggcagcaattgcagcacgtaatcccgcgccaccggcgcctacaatggcaagatcggcttgaaaggtttgcacgacattcctccagattgtttttatcccacagccacgtacttcagggtaagtacctgaaagttacggtctgcgaacgctattccactgctcctttataggtacaacagtatagtctgatggataagtctgaaatttgacgagatcgatttttttagtgcgcaagagggctaaattatcactgaagatgattaatttaattactaaaccatcagatcgtgctttttttagtcactgcccaccgctgtttgattcctgcgtaaaatttgtctcgccgtcgcgttgcgagtagacttcgtgcccttgtcaaaaactggagatttaactatgagcgaaacggcatcctggcagccgagcgcatccattcctaacttattaaaacgcgcggcgattatggcggagatccgtcgtttctttgccgatcgtggagtgctggaggtggagacgccttgtatgagccaggcgacggtaaccgatattcatttggtcccgtttgagacacgtttcgttggccccgggcattcgcaggggatgaatctctggttaatgaccagcccggaataccatatgaaacgcctgctggttgccggttgtgggccggtattccagctgtgccgcagcttccgtaatgaagagatggggcgttatcacaaccctgagttcactatgctggagtggtatcgaccgcactatgatatgtaccggttgatgaacgaggtggacgatctcttacaacaggtgctggactgcccggcagcagaaagcctttcttatcaacaagctttcttgcgttatctggaaattgacccgctctctgccgacaaaacgcaactgcgggaagtcgcagcgaaactggatttgagcaatgttgctgataccgaagaagaccgcgacacgctgctacaattgctgtttacctttggcgtagagccaaatattggcaaagaaaaaccgacctttgtgtaccactttccagccagccaggcatcactggcgcaaatcagtaccgaagatcatcgggtcgctgaacgctttgaggtttattataaaggtattgagctggcgaatggtttccatgaattgacggatgcccgtgagcagcaacaacgctttgaacaagataaccgtaagcgcgcggcgcgcggtttgccgcagcaccccattgaccagaatctgattgaagccttgaaagtcggtatgcctgactgttccggcgtggcattaggtgttgatcgtctggtgatgttggcgctgggcgcggagacactggctgaagtcatcgcctttagcgttgaccgggcataattctgaaaaattactgaattaacagcgaagaatggcgtgataagcgccattctgtagcatatgttttcatttttccgttaaaggccacaatttaagactggatatttgatatcatccaggtatcaattctgtattggtttttacgctgcctgctcaatgttgcgcagtgcagttcagtgggcacgtgttatacacgcgctgaaatgaaggatggtttcatgcctcacacgataaaaaagatgagtctgataggactcatattgatgatctttacttccgtatttggatttgccaatagcccatcggcttattacttaatgggttatagtgcgattcccttttatatattttctgcattgttattctttattccattcgccttaatgatggctgaaatgggagctgcttatcgcaaagaagaaggcggtatctattcctggatgaataatagtgtcggaccacgttttgccttcattggtacgtttatgtggttttcctcttatatcatctggatggtgagtacctccgcgaaagtttgggtaccgttctcaacattcctctatggtagcgacatgacccagcactggcgtattgccggactggagcctacgcaggtggttggtctgctggctgtggcatggatgattctggtcaccgtcgttgcttctaaggggattaataaaattgcccgcattactgcggtgggcggtattgcagtaatgtgtctgaatttagtattgctgttagtaagcattactattttgttattaaatggtgggcatttcgcgcaggatattaatttccttgcatcaccgaacccgggttatcagtccggtctggcaatgctatcgtttgtggtatttgccatttttgcctatggcggaattgaagcggttggtggtctggtcgataaaacggaaaatccagaaaagaactttgccaaaggtattgtttttgccgctattgttatttcaatcggttattcgctggcaatatttttatggggcgtcagcacaaactggcagcaggtattaagtaatggttccgttaacctcggcaatattacctatgtgctgatgaagagccttgggatgacgctgggtaatgcactgcatttgtcacctgaagcgtcattgtcgctgggcgtatggtttgcgcgtattactggactttcgatgttcctcgcctataccggtgcgttctttacgctttgctattcaccgttgaaagccatcatccaggggacgccgaaagcattgtggccggaaccgatgacgcgcctgaatgcgatggggatgccgtctatcgccatgtggatgcagtgcgggttggttactgtcttcatcctgctggtttcgtttggtggcggtaccgcatcggcgttctttaacaagctgacgctgatggcgaacgtgtctatgacgcttccttacctgttcctcgcgctggctttcccgttctttaaagcacgtcaggatctcgacagaccgtttgtgattttcaaaacgcatttgtcggcaatgattgcgacagtggttgtcgtactggtggtgacatttgcgaacgtcttcaccatcattcaacctgtggttgaagccggagactgggacagcacattgtggatgattggcggccctgtcttcttctcgctgttagcgatggcgatttaccagaactattgcagcagagtggcaaaaaatccgcagtgggcggtggaataacccgatgccctatcgtctacctgacgatagggcgtaaagacaggaaatgttatggatgacaccagccgggacccggcaataaccgaagatgaaatcagggcgctgcaattttctgccggggatgtagcggaaatagagcagacgattctctcttttgtcgatgcctgccacacccgtaaagtggcgatggtggtgggtagcaccattaacaccctcaaagatcgcgatggtaaacggtggggaaacctgccggatatttattgcgcttatcttatccgatgtctggtttttcgcggggaattagtgggatacggcgatttgtttcgtatgcgctatagcgaaattaagcgaccggttaccttatgagtgcgcgcatgtttgtcttatgctgcatctggtttattgtggcgttcctctggataaccatcacttccgcgctggacaaagagtggatgattgatggacgcgggattaacaacgtctgcgatgtgttgatgtatctcgaagaagacgatacccgtgatgttggtgtgataatgacgttaccgctctttttcccttttctctggttcgctttgtggcgaaaaaaacgcggctggtttatgtacgccaccgcgctggctattttcggctactggctgtggcagttttttctgcgctatcagttttgtttgtgagccggattggttcatccggcacacaaacttacaaacttcccgcctgacgacctttgcccgcagacgtcagcgttctccccgtttgtttaccgttgaggctttccagacgcatctggaagggcgggaatggcatatcgataccgtgggcatggaagccagccagaatcagctggtggatctcatggcgtagcggcatacggtgacccatctcagcggcgtaaatacgcagctcgaaaatctgaatcccctgttgcagatccaccaggaagacttccggtgccgggttgtcgatcaccagcgagcagcgacgcgctgcggtgagcaggatttccgtcacttcttcgctattggcatcggcaggggccggtatcgtcaacaccacgcgcgtgaccgagtcagagagcgaccagttgataaactgctcggtaataaacgccttgttcggcacgattatctctttacggtcccagtcgctgatggtggtggcgcgggtgttaattttcgtcacgctaccggtgagatcgcgaattgtcaccgtatcgccaatgcgaatcggtttttcgaacaggataatcagaccagagataaagttggcgaaaatttcctgcaaaccaaaaccgagaccaacaccgagcgcggcaaccagccactgcaatttcgaccactcaataccaatcattgagaagccgaccagcccgccaatcagcatcagcagatatttggtgatggtggtgatggcgtaacccgtacccggcgttaaatccaggtgctgcaaaatcgccagttccagcagcgcgggcaagttgcgcaccagctgcgtggtgatgataaacaccagaatggcaatcagcaccgcaccgagggtaattggctccagactttctacgccctgtaccgtggaggtgacatcccacagcgaaatattttcgaggaagccgaaagcggaatggatttctgaccacagcacaatgacagaaagcagggcgatcaacatcaaaattgagcgcaccagccgcaaggattgcgcactgatggcatcgagatcgacttcgctttcatcgacttcaattgctccttccgggctactgtgatgatgcgcttcctcttcgccacgcgcacgttgcgctaacatctctgcccggcgatgcttcgcccgatcaaacgccagcctgcggcgctggatcagcatccagcggcggataacgtgataaaccaccagtagcaggaaccagatggcaaccgaggtttcaagcctcgctaacagcgcctgtgccgttgccagataacccaccgccgacgccagaatggcaaccaacggcgcgccaatcatcatgttccacagcatatggttggtaatgttgtcgccgctgccctctttgttgagatacagcggaatcccggcctttttcaggctgagggtgaccaccgccagcgcaccgcaaatgaggataaagcaaagccgtcccagcgaaccggagaattcacggtcgtcgaggttatcgaacatcatcagcgccataatcagcggcacaataagcccgatgctcatcaggtagtagcgcatcccacgggaaacacgttcgcgcggccagccaaaatgagcgataaacaagccgttcgggcgggcaaaggtggcgcaaatcatcactacccacagcagcggcacggtggccgttacaccatcgccaatcgcgaccgccagcggataaggccacgcctcgcgcaagccgtaacccagcgtcatccacagcaccggtaacggtgacgcgacgagaatcgaccagaaaagagtgcgcaacgtcagccagaagtgatcctgagtcactttgccaactttcgccgccgaacgttcaagaaaacgggtgaaatagcggcgcgagtaaatactgcaaccgaccagaatcaacgcgccaaacagcggcaaaattgtctctttgctggtcagcatcatcacactggctttgcccaactgactgaaggtgtccagcgaaatgagacgacgcagatcctgggcgatttccagcggccaggcgatggtcatcgggcgcacgtcagaggtccagaacagatagcggtgcgttgcttcgttcacctctttcagcgcatcctccagttgcccgttggagactttcagcttggtcagttccaatagtagcgtgtcgccaccctgcaacaatgagttcagcaactcacgctgagtgcgcagttgtgcttccagaatacggttttgctcggcagtcagcggctgaccgtcggcctgatgaatttgccgtagcagcggctgtttattaagcagatcctcataacgtaaccgttgcacacgcaactgcgccatttcggtatcaagctgttgtggtttcggcatttccggcagccgtgccacctgcgcccgcagcgcttcgccgagcagattggacgatcccagccattgcgactgttcacgcagcgtattcaacgcctgccggacctgtaacgtctggctggcagcctgacgctgttgcgaggcaacgagatccatccgctgcgcctgttgattcaaagccgccgatagttcgcggttaattttgaattgcgcgacgatatctttcggcaaatcggcgctgttttctgccagcaattcggtactttccagcgcccgctccgcctcaagctgacgttggctgtttaattgattacgcaaggcctgcaaatacgcatccagttgctggctctctttttccgccagctctgagcgtaagcgcgctaattcctggcggttattggcagacagctgcgccagctccagttcatcaacgagcgccttaagacgtgcagagtcagactgcaacgcgaaattttgtgcctgattgagcggagtattgccggtaagcgttcccaggcggcgctcgatctcatttaactgacggcgggcgtcggtttgctgttgcggcagttgattcagcgaatcggcaatctcgcgggcgcgctcctgctcttgctgggcctgacggcttttatccagcaactggctgctgacctggagaatttcctgattcagcgcgtcggtagacattcccggcgacacgctgcgcggctcgtcacgcatgttgtttaattgtgcgcgcagagtagcggagagtttcggataattatcgataacttgctgatattgtttgatgcgctcaagggaaccttttcgttcctcaagcgcatttaaggcagactggagcgcctctacgacttccggctgtgcgggtttcgccgcttttgcctgctccagttcctgagtgatttgtttgctatcgggggccgtcgcggcgtacgccccccaactgaggcaccaggccatcagaaaagtgataatcaggcgcacgtcagcgtttcctttgatggattagacctggtcttttttgtcgtcaaccaatgggctggcgtcgtgttctgcttcgatctcttcagcaggaagcggggcaggttcagcgtctggcgtaacaaaggtttcggtagatactgccagcggctggccaattttcgtgacagacaggctttccagttgctcaaccagattcactttacccggtgcaaacaggttgataacggtggaaccgagtttaaagcgacccatttcctggcctttcagcagtgccacagaaccgtcgttttccccggcaggccaggtccagcgcttgatgataccttcgcgcggcggcgtaatggtgcccgcccagaccgtctcaatgctgccaacaatcgtcgctccgaccagaatctgcgccattgggccaaattcggtatcgaaaaggcaaatcacgcgttcgttacgggcaaacagattcggcacgttctgagccgtgagatggttaacggagaagagatcgcccggcacgtagatcatctcacgcagaataccgttgcacggcatgtgtacgcggtggtagtcacgcggggagaggtaagtggtcacaaacgtaccgttgcggaacaggtccgccatcagatagttgcctgccagcagggcttcgaggctgtagttgtggcctttggcttgcaggattttatcttcttcgattttacccaactggctgataacgccatcggcaggcatgaccagtacattcggatcggtatcgattgggcgtacttcgtcacgcagcggacggacaaagaattcgttaaaggtgcggtagctggcggtgtccggcttttgcgcctctttcatgtcgaccttgtagtatttaacgaacagatcgataaccagttttgtcagccatcctgcccgcttgcttgcgccccaacccgccaggcgagtaagccatagtttcggcagaatgtactgtagcgaaagtttaaatgaatttaacaaggtagcctccaggccattgttttgtcgttcctgatccggcctacatgccggatcctgaaaaaaaggggacgattctaacgacggttagcttaattgtcagtcatccgtatcagaaaagtttttacgcgtttttacctgcgccatgctttccagaatacggtgatagttttcgaaacgggtttccgcgattttcccttcctcaaccgcttcccggatagcgcagcccggatcggtatcgtgtttgcaatcgcgatatttacacagacctaaatagtcatggaattcgacaaagccctgagtgatttgttccggctccaggtgccagaggccgaactcacgcactcctggggagtcaatcacatcaccgccgtgcgggaagtgatacagccgagcggcggtcgtggtgtgctgaccgagccccgagttgtcagagatatcgttggtcaggatctctttttgcagccccagcaacgcattcagcaggctggatttgccgacgccagactgcccggcaaaaatgctgatgcgcccggtcaacgcctcttccagcggttttagcccatcctgagtatggctggaaaccatcaatacgcgataaccgatattgcggtagatatccatctgctcgttgacgaacgccatgccttcgtcgtccagcaggtctatcttgttgagcacaataatcggctcaatctgcaaggtttcgcaggccaccaggtaacggtcgataatattgagcgacagctccggcaaaatggcggagacaatgacaatctggtcgatgttggcggcaataggttttacgccgtcgtagaaatccggacgcgtcaacaccgaggtacgctcatgcaccgcttccacgatccctttgacatttacgccttccgccgccggtttacccggacgccagactacgcggtcgccggttaccagcgaacggatggtacggcgaatattgcagcggtgaacgtcgccatcggcggattccacatcagcgtgcataccaaagcggctgatgacgataccttcatcaggctcgccaaacagattgtcgtcgtagtcgggcttctccttagacgttttaagacgacgctggtgattggcgttcacgcggcgctgctggcctttggagagtttatttttactcaatcgtacagactcctggtcgcccctgatgggcaaaacatctatgatacacgcaattgtggatcaatatagtcactgtgaatgggtggaaaatagcatgagtgccaatgaaaacaacctgatttggatcgatcttgagatgaccggtctggatcccgagcgcgatcgcattattgagattgccacgctggtgaccgatgccaacctgaatattctggcagaagggccgaccattgcagtacaccagtctgatgaacagctggcgctgatggatgactggaacgtgcgcacccataccgccagcgggctggtagagcgcgtgaaagcgagcacgatgggcgatcgggaagctgaactggcaacgctcgaatttttaaaacagtgggtgcctgcgggaaaatcgccgatttgcggtaacagcatcggtcaggaccgtcgtttcctgtttaaatacatgccggagctggaagcctacttccactaccgttatctcgatgtcagcaccctgaaagagctggcgcgccgctggaagccggaaattctggatggttttaccaagcaggggacgcatcaggcgatggatgatatccgtgaatcggtggcggagctggcttactaccgcgagcattttatcaagctgtaaaatttttcctggtcacgtaagcgccggaatccacttgcggcggcgtgattttgacgctaaattgaacgtcttgctgataatttcagcacttgagataaaaacgcaaaaaaaacttttttggggggttgcagagggaaagatttctcgtataatgcgcctcccgtaacgacgcagaaatgcgaaaattacgaaagcaaaattaagtagtacgcgggaatagctcagttggtagagcacgaccttgccaaggtcggggtcgcgagttcgagtctcgtttcccgctccaaaatttgaaaagtgctgcaaagcacagaccacccaagcgggaatagctcagttggtagagcacgaccttgccaaggtcggggtcgcgagttcgagtctcgtttcccgctccaaaatttgaaagtgctgtaaggcacagaccacccaagcgggaatagctcagttggtagagcacgaccttgccaaggtcggggtcgcgagttcgagtctcgtttcccgctccaaattcttctctcaataaaatatccacagcgacgcgatgcgttattgctggtttttgttgtctctgacaaactcttgtaaacagagttatccacagcctcaggctgtaatcttaatttcaaagaaacttcgcacggtgaatagtatttttttaacctattgatagataagttaaaaattaagattccgttttgtcgagtcgatcacttgacgattttattcgtcttgaattgcaatgcgtttttatttttattcacaagctgtggatgaatcaggcgtcacgcggtaaccctttttcaatcacccgaaccagacgctgttttttcggcaattgcacttcgactatgcacgcatttcgtctctctatttgctgcgcaatcgcccacgctatgtgctcatcgagaagtgggtgctcacctttacgactttccagcgctgtcaaaatcgtttcatcccaaggggcattgcctaatgctacggcgatattacgcagccaacgcaggtgaccaatacgacgaatcgccgatccttccgtgacttttaaaaacttctcttcgctccaggcgaataactcaatgagttccggtgcgtgtagcggcttacgcgggctgaaatcctcttctgtggtgagttgtgaatagcgattccacgggcagataagctggcagtcatcgcaaccgtaaatacggtttcccattaacggtcgcaactcttccgggatcgccccttcaagttcgatggtgagataagagatacagcggcgagcatcgacggtatatggctcgacgatggcaccggtcgggcaaatcgtcatacaggccacgcatttgccgcatccttcctcgactggttgatccacgggcagcggaatatcgaccagcaattcgcctaaaaagaagaacgaaccggcctcgcgattgaggataagtgagtgcttacctgtccagccgagcccagctttttcagctaacgggcgctcgagaataggcgcagaatcgacaaacggtctaaaattcagcgaaacacaatgttgctgaatcatctcgcccagctttttgagtcggttgcgcagaagtttgtgatagtcacggcccagcgcataacggctaacatagccgagtttggggtttttcagcgtgctggcaaatgcggcgttagcaggaaggtaattcatccgcacgctgatcacgcgcagcgtaccgggcaataactcatgagggcgagcgcgcagcataccgtgacgtgccatccagtccatttcgccgtggtattgtttgtccagccatgcttgcagtttgggctcggactcgctgagatcggtatcggtaatacctacctgctgaaagcccagttccagcccccactgtttaattttttgcgctaactgattgagatcgaggggctctgacatgacggaccatacaatgaagaaaaaccccgtaagtataccacacaccgtctggtacgccgacgatatccgccgcggagaacgcgaggcggcagatgtgctggggctcacactctatgagctgatgcttcgcgctggcgaggccgcattccaggtgtgtcgttcggcgtatcctgacgcccgccactggctggtgctgtgcggtcatggtaataacggcggcgatggctacgtggtcgcgcgactggccaaagcggtcggcattgaggtcacgttgttggcccaggagagcgacaaaccgttgccggaagaggccgcgctggcacgcgaagcatggttaaacgcgggtggcgagatccatgcttcgaatattgtctggcccgaatcggtagatctgattgttgatgcgctgctcggtaccggtttgcggcaagcgccccgcgaatccattagccagttaatcgaccacgctaattcccatcctgcgccgattgtggcggttgatatcccttccggcctgctggctgaaactggcgctacgccaggcgcggtgatcaacgccgatcacaccatcacttttattgcgctgaaaccaggcttgctcactggaaaagcgcgggatgttaccggacaactgcattttgactcactggggctggatagttggctggcaggtcaggagacgaaaattcagcggttttcagcagaacaactttctcactggctaaaaccgcgtcgcccgacttcgcataaaggcgatcacgggcggctggtaattatcggtggcgatcacggcacggcgggggctattcgtatgacgggggaagcggcgctgcgtgctggtgctggtttagtccgagtactgacccgcagtgaaaacattgcgccgctgctgactgcacgaccggaattgatggtgcatgaactgacgatggactctcttaccgaaagcctggaatgggccgatgtggtggtgattggtcccggtctgggccagcaagagtgggggaaaaaagcactgcaaaaagttgagaattttcgcaaaccgatgttgtgggatgccgatgcattgaacctgctggcaatcaatcccgataagcgtcacaatcgcgtgatcacgccgcatcctggcgaggccgcacggttgttaggctgttccgtcgctgaaattgaaagtgaccgcttacattgcgccaaacgtctggtacaacgttatggcggcgtagcggtgctgaaaggtgccggaaccgtggtcgccgcccatcctgacgctttaggcattattgatgccggaaatgcaggcatggcgagcggcggcatgggcgatgtgctctctggtattattggcgcattgcttgggcaaaaactgtcgccgtatgatgcagcctgtgcaggctgtgtcgcgcacggtgcggcagctgacgtactggcggcgcgttttggaacgcgcgggatgctggcaaccgatctcttttccacgctacagcgtattgttaacccggaagtgactgataaaaaccatgatgaatcgagtaattccgctccctgatgagcaggcaacattagacctgggcgagcgggtagcgaaagcctgcgatggcgcaaccgtaatctatctgtatggcgatttaggcgcaggtaaaaccacctttagccggggctttttacaggctctgggtcatcagggtaatgtcaaaagccccacttatacgctggtcgaaccctatacgctcgacaacttaatggtctatcactttgatttgtaccgccttgccgatcccgaggagctggagtttatggggatccgcgattattttgccaacgatgccatctgcctggtggagtggccacaacaaggtacaggtgttcttcctgacccggatgtcgaaatacacattgattatcaggcacaaggccgtgaggcgcgcgtgagtgcggtttcctctgcgggtgaattgttgctggcgcgtttagccggttaacctttgaaaggtggcgggatgatgtatcgcatcagaaattggttggtagcgacgctgctgctgctgtgcacgccggtgggtgccgcgacgctctctgatattcaggtttctaacggtaatcaacaggcgcggataacgttgagttttattggcgatcctgattatgcgtttagccatcaaagcaaacgcaccgtggcgctcgatatcaaacaaacgggcgtgattcagggactgccgttgttgttcagcggcaataatctggtgaaggcgattcgctctggaacgcctaaagatgcacaaacgctacggctggtggtcgatcttaccgaaaacggtaaaaccgaagcggtgaagcggcagaatggcagcaattacactgtcgtctttacgattaacgccgatgtgccgccaccgcctcctccgccgcccgtggttgcgaaacgcgttgaaacgcctgcggttgtcgcaccgcgcgtcagcgaaccggcgcgcaatccgtttaaaacggaaagtaaccgcactacgggtgttatcagcagtaatacggtaacgcgtccggcagcgcgcgcgacggctaacactggcgataaaattatcatcgctattgatgccggacacggcggtcaggaccctggcgctatcggccccggtggtacgcgggagaaaaatgtcaccatcgccatcgcgcgtaaattgcgtactttgctcaatgacgatccgatgtttaaaggcgttttaacccgtgacggggattactttatctcggtgatggggcgcagtgatgtggcacgtaagcaaaacgccaatttcctcgtgtcgattcacgctgatgccgcaccgaaccgcagtgcgactggcgcttccgtatgggtgctctctaaccgtcgcgccaacagtgaaatggccagctggctggagcagcacgagaaacagtcggagctgctgggtggggcgggtgatgtgctggcgaacagtcagtctgacccctatttaagccaggcggtgctggatttacagttcggtcattcccagcgggtagggtatgatgtagcgaccagtatgatcagtcagttgcaacgcattggcgaaatacataaacgtcgaccagaacacgccagccttggcgttctgcgctcgccggatatcccatcagtactggtcgaaaccggttttatcagcaacaacagcgaagaacgtttgctggcgagcgacgattaccaacaacagctggcagaagccatttacaaaggcctgcgcaattacttccttgcgcatccgatgcaatctgcgccgcagggtgcaacggcacaaactgccagtacggtgacgacgccagatcgcacgctgccaaactaaggacgattgatgccaattcaggtcttaccgccacaactggcgaaccagattgccgcaggtgaggtggtcgagcgacctgcgtcggtagtcaaagaactagtggaaaacagcctcgatgcaggtgcgacgcgtatcgatattgatatcgaacgcggtggggcgaaacttatccgcattcgtgataacggctgcggtatcaaaaaagatgagctggcgctggcgctggctcgtcatgccaccagtaaaatcgcctctctggacgatctcgaagccattatcagcctgggctttcgcggtgaggcgctggcgagtatcagttcggtttcccgcctgacgctcacttcacgcaccgcagaacagcaggaagcctggcaggcctatgccgaagggcgcgatatgaacgtgacggtaaaaccggcggcgcatcctgtggggacgacgctggaggtgctggatctgttctacaacaccccggcgcggcgcaaattcctgcgcaccgagaaaaccgaatttaaccacattgatgagatcatccgccgcattgcgctggcgcgtttcgacgtcacgatcaacctgtcgcataacggtaaaattgtgcgtcagtaccgcgcagtgccggaaggcgggcaaaaagaacggcgcttaggcgcgatttgcggcaccgcttttcttgaacaagcgctggcgattgaatggcaacacggcgatctcacgctacgcggctgggtggccgatccaaatcacaccacgcccgcactggcagaaattcagtattgctacgtgaacggtcgcatgatgcgcgatcgcctgatcaatcacgcgatccgccaggcctgcgaagacaaactgggggccgatcagcaaccggcatttgtgttgtatctggagatcgacccacatcaggtggacgtcaacgtgcaccccgccaaacacgaagtgcgtttccatcagtcgcgtctggtgcatgattttatctatcagggcgtgctgagcgtgctacaacagcaactggaaacgccgctaccgctggacgatgaaccccaacctgcaccgcgttccattccggaaaaccgcgtggcggcggggcgcaatcactttgcagaaccggcagctcgtgagccggtagctccgcgctacactcctgcgccagcatcaggcagtcgtccggctgccccctggccgaatgcgcagccaggctaccagaaacagcaaggtgaagtgtatcgccagcttttgcaaacgcccgcgccgatgcaaaaattaaaagcgccggaaccgcaggaacctgcacttgcggcgaacagtcagagttttggtcgggtactgactatcgtccattccgactgtgcgttgctggagcgcgacggcaacatttcacttttatccttgccagtggcagaacgttggctgcgtcaggcacaattgacgccgggtgaagcgcccgtttgcgcccagccgctgctgattccgttgcggctaaaagtttctgccgaagaaaaatcggcattagaaaaagcgcagtctgccctggcggaattgggtattgatttccagtcagatgcacagcatgtgaccatcagggcagtgcctttacccttacgccaacaaaatttacaaatcttgattcctgaactgataggctacctggcgaagcagtccgtattcgaacctggcaatattgcgcagtggattgcacgaaatctgatgagcgaacatgcgcagtggtcaatggcacaggccataaccctgctggcggacgtggaacggttatgtccgcaacttgtgaaaacgccgccgggtggtctgttacaatctgttgatttacatccggcgataaaagccctgaaagatgagtgatatcagtaaggcgagcctgcctaaggcgatttttttgatggggccgacggcctccggtaaaacggcgttagccattgagctgcgtaaaattttaccagtagagttgataagcgttgattctgcccttatttacaaagggatggatatcgggacggcgaagccgaacgctgaagagttactcgccgcgccgcaccgattgctggatattcgcgatccgtcgcaggcttactcggctgctgattttcgccgcgatgcgctggcggaaatggccgatatcaccgcggcggggcggatcccactgttagtgggcggtacgatgttgtatttcaaggcattgctggaagggttgtcgccgctaccgtcggcagacccggaagtacgggccagaattgagcaacaggcggcagagcaaggttgggagtcattgcatcgtcaacttcaggaggtagatccggttgcggcagcaaggattcatccaaatgatccacaaaggctttcccgggcactggaagtttttttcatttcgggtaaaactttaacggaactgacgcaaacgtcaggagacgctctaccgtatcaggtgcatcagttcgccatcgccccggcgagccgtgaactgctccatcaacgcattgagcagcgttttcatcagatgttggcttcaggttttgaagcagaagtccgggcgctttttgcccgaggagatttgcatacggacttgccttccattcgttgcgtgggttatcgccagatgtggtcttaccttgaaggcgaaatctcatacgatgaaatggtttatcgaggtgtttgcgccacgagacagttggcgaagcggcagataacctggctgcgtggttgggaaggggttcactggcttgacagtgaaaaaccagaacaggcgcgtgacgaagtattacaggttgttggtgctatcgcaggctgaatgtgtacaattgagacgtatcgtgcgcaattttttcagaatcgaaaggttcaaagtacaaataagcatataaggaaaagagagaatggctaaggggcaatctttacaagatccgttcctgaacgcactgcgtcgggaacgtgttccagtttctatttatttggtgaatggtattaagctgcaagggcaaatcgagtcttttgatcagttcgtgatcctgttgaaaaacacggtcagccagatggtttacaagcacgcgatttctactgttgtcccgtctcgcccggtttctcatcacagtaacaacgccggtggcggtaccagcagtaactaccatcatggtagcagcgcgcagaatacttccgcgcaacaggacagcgaagaaaccgaataaggtttcgggctgtttttttacacggggagccagcgatcctgcgttccccgctgatctatttagagggttatacgcttgtttgaccgttatgatgctggtgagcaggcggtactggtacacatctattttacgcaagacaaagatatggaagacctccaggagtttgaatctctggtctcttccgccggtgtcgaagcattgcaggtgattaccggtagccgtaaagcgccgcacccaaagtattttgtaggtgaaggtaaagcagttgaaattgcggaagctgtcaaagcgacgggtgcttcggtcgttctttttgaccatgccctgagcccggcgcaagagcgtaacctggagcgtttgtgcgagtgtcgtgttatcgaccgcaccggccttattttagatattttcgcccaacgtgcgcgtacccatgagggtaagttgcaggttgagctggcgcagctgcgccatctggctacgcgcctggtgcgtggctggacccaccttgaaagacagaaaggcgggataggtttgcgtggtccgggtgaaacccagctcgaaaccgaccgtcgtttgttgcgtaatcgcatcgtgcagatacagtcgcgcctggaaagagttgaaaagcagcgtgagcaggggcggcaatcgcgtatcaaagccgacgttcctactgtttcgctggtgggatataccaacgccggtaaatctacccttttcaatcgcatcaccgaagcgcgggtctacgcggcagaccagttgtttgccaccctcgacccgacgttgcggcgtattgacgttgcagatgtcggtgaaaccgtacttgcagataccgtagggtttattcgccacctgccgcacgatctggtggcggcatttaaagccacgttacaagagacgcggcaagccacattactgctgcacgtcattgatgcggcggatgtgcgtgtacaagaaaacatcgaagcggtgaatacggttcttgaagagatcgacgctcacgagatcccaaccctgctggtgatgaacaagatcgatatgctggaagatttcgaaccgcgtattgatcgggacgaagagaacaaaccgaaccgtgtctggctttccgcacagaccggagcggggataccacagctttttcaggctttgacggagcggctttccggcgaggtggcgcagcatacattgcgtctgccaccgcaggaagggcgtctgagaagtcgtttttatcagcttcaggcaatagaaaaagagtggatggaggaggacggcagcgtaagtctgcaagttcgtatgccgatcgttgactggcgtcgcctctgtaaacaagaaccggcgttgatcgattacctgatctaacggcgtagcgtctgaagcgtggagtcatatcctctggcgtcgaaagacaacagggatcaccgcataacaaatatggagcacaaacatggcgtggaatcagcccggtaataacggacaagaccgcgacccgtggggaagcagcaaacctggcggcaactctgagggaaatggaaacaaaggcggtcgcgatcaagggccacctgatttagatgatatcttccgcaaactgagcaaaaagctcggtggtctgggcggcggtaaaggcaccggatctggcggtggcagttcatcgcaaggcccgcgcccgcagcttggcggtcgtgtcgttaccatcgcagcggcagcgattgtcattatctgggcggccagtggtttctataccattaaagaagccgaacgcggcgtggtaacacgctttggtaaattcagccatctggttgagccgggtctgaactggaaaccgacgtttatcgacgaagtcaaaccggtgaacgtggaagccgtgcgtgaactggccgcttctggtgtgatgctgacgtcggacgagaacgtagtgcgcgttgagatgaacgtgcagtaccgcgtcaccaatccggaaaaatatctgtatagcgtgaccagcccggatgacagcctgcgtcaggctaccgacagcgccctgcgtggagttatcggtaaatacaccatggaccgcattctgacggaaggtcgtaccgtgattcgtagcgatactcagcgcgaactggaagagacgattcgtccgtatgacatgggtatcacgctgctggacgtcaacttccaggctgctcgtccgccggaagaagtaaaagcggcgtttgacgatgcgattgccgcgcgtgaaaacgaacagcaatacattcgtgaagcagaagcgtataccaacgaagttcagccgcgtgcgaacggtcaggcgcaacgtatcctcgaagaggcgcgtgcgtacaaggcccagaccatcctggaagctcagggtgaagtggcgcgctttgctaaacttctgccggaatataaagccgcgccggaaattactcgcgagcgtctgtatatcgagacgatggaaaaagtgttgggtaacacccgcaaagtgctggttaacgataaaggtggcaacctgatggttctgccgttagaccagatgctgaaaggtggtaacgcccctgcggcgaagagcgataacggtgccagcaatctgctgcgtctgccgccagcctcttcctccacaaccagtggagcaagcaacacgtcgtccaccagtcagggcgatattatggaccaacgccgcgccaacgcgcagcgtaacgactaccagcgtcagggggaataacgatgcgtaagtcagttatcgcgattatcatcatcgtgctggtagtgctttacatgtctgtctttgtcgtcaaagaaggtgagcgcggtattacgctgcgttttggtaaggtactgcgtgacgatgacaacaaacctctggtttatgagccgggtctgcatttcaagataccgttcattgaaacggtgaaaatgctcgacgcacgtattcagaccatggacaaccaggccgaccgctttgtgaccaaagagaagaaagacctgatcgtcgactcttacatcaaatggcgcatcagcgatttcagccgttactacctggcaacgggtggtggcgacatttcgcaagcggaagtgctgttgaaacgtaagttctctgaccgtctgcgttctgaaattggtcgcctggacgtgaaagatatcgtcaccgattcccgtggtcgtctgaccctcgaagtacgtgacgcgctgaactccggttctgcgggtacagaagatgaagttactaccccggcggcagataacgccattgccgaagcggcagagcgcgtaacggctgagacgaagggcaaagttccggtcatcaacccgaacagtatggcggcgctgggtattgaagttgtcgatgtgcgtatcaagcagatcaacctgccgaccgaagtgtctgaagcgatctacaaccgtatgcgcgccgagcgtgaagcggtagcgcgtcgtcaccgttcacaaggtcaggaagaagcggaaaaactgcgcgcgactgccgactatgaagtgaccagaacgctggcagaagctgagcgtcagggccgcatcatgcgtggtgaaggcgatgccgaagcagccaaactgtttgctgatgcattcagtaaagatccggacttctacgcattcatccgtagcctgcgtgcttatgagaacagcttctctggcaatcaggacgtgatggtcatgagcccggatagcgatttcttccgctacatgaagacgccgacttccgcaacgcgttaatataacgactgcggtacaggtcaataaagccaccgcatcctcagggatgtcggtggttttctttttctataaggataatgaatgaattcgacaatctggctggcgcttgccctggttttggtactggaaggtttagggccgatgctttacccgaaggcatggaagaagatgatctctgcgatgaccaatttgcccgataatattttacgtcgttttggcggtggacttgtggttgcgggcgttgtggtctactacatgttgaggaaaacgattggctgaacaaaaaacagactgatcgaggtcatttttgagtgcaaaaagtgctgtaactctgaaaaagcgatggtagaatccatttttaagcaaacggtgattttgaaaaatgggtaacaacgtcgtcgtactgggcacccaatggggtgacgaaggtaaaggtaagatcgtcgatcttctgactgaacgggctaaatatgttgtacgctaccagggcggtcacaacgcaggccatactctcgtaatcaacggtgaaaaaaccgttctccatcttattccatcaggtattctccgcgagaatgtaaccagcatcatcggtaacggtgttgtgctgtctccggccgcgctgatgaaagagatgaaagaactggaagaccgtggcatccccgttcgtgagcgtctgctgctgtctgaagcatgtccgctgatccttgattatcacgttgcgctggataacgcgcgtgagaaagcgcgtggcgcgaaagcgatcggcaccaccggtcgtggtatcgggcctgcttatgaagataaagtagcacgtcgcggtctgcgtgttggcgaccttttcgacaaagaaaccttcgctgaaaaactgaaagaagtgatggaatatcacaacttccagttggttaactactacaaagctgaagcggttgattaccagaaagttctggatgatacgatggctgttgccgacatcctgacttctatggtggttgacgtttctgacctgctcgaccaggcgcgtcagcgtggcgatttcgtcatgtttgaaggtgcgcagggtacgctgctggatatcgaccacggtacttatccgtacgtaacttcttccaacaccactgctggtggcgtggcgaccggttccggcctgggcccgcgttatgttgattacgttctgggtatcctcaaagcttactccactcgtgtaggtgcaggtccgttcccgaccgaactgtttgatgaaactggcgagttcctctgcaagcagggtaacgaattcggcgcaactacggggcgtcgtcgtcgtaccggctggctggacaccgttgccgttcgtcgtgcggtacagctgaactccctgtctggcttctgcctgactaaactggacgttctggatggcctgaaagaggttaaactctgcgtggcttaccgtatgccggatggtcgcgaagtgactaccactccgctggcagctgacgactggaaaggtgtagagccgatttacgaaaccatgccgggctggtctgaatccaccttcggcgtgaaagatcgtagcggcctgccgcaggcggcgctgaactatatcaagcgtattgaagagctgactggtgtgccgatcgatatcatctctaccggtccggatcgtactgaaaccatgattctgcgcgacccgttcgacgcgtaattctggtacgcctggcagatattttgcctgccgggcgaacagtgtgatacattgctgtgtcgggtaagccattacgctatccgacacagtgttaaatcctcgcttttttccttccccgaactgaaataaattagcgacacagcttgtggctggtttatcatcaatataaatgtattttttcccgatttcccttttgaggttgatgtgcagttaacgagtttcactgattacggattacgtgcgctgatctacatggcgtcattgccagaagggcggatgaccagtatttctgaagtgactgacgtctacggcgtctcccgtaatcatatggtcaaaataatcaatcaacttagtcgtgccggctacgtgactgctgttcgtggaaaaaatggcggcattcgcctgggtaaaccggcgagtgcgatacgtattggtgatgtggtgcgcgagctggagcccttatcgctggtgaattgcagcagtgagttttgccacattacacctgcctgtaggttgaaacaggcactttctaaggccgtgcaaagttttcttacggaactggataactacacgcttgccgatttggttgaagagaatcaaccgctttataaattattgctggtggagtgacgaaaatcttcatcagagatgacaacggaggaaccgagatgtcacaagatcctttccaggaacgcgaagctgaaaaatacgcgaatcccatccctagtcgggaatttatcctcgaacatttaaccaaacgtgaaaaaccggccagccgtgatgagctggcggtagaactgcacattgaaggcgaagagcagcttgaaggcctgcgtcgccgcctgcgcgcgatggagcgcgatggtcaactggtcttcactcgtcgtcagtgctatgcgctgccggaacgcctcgacctggtgaaaggtaccgttattggccaccgtgatggctacggctttctgcgggttgaagggcgtaaagatgatttgtatctctccagcgagcagatgaaaacctgcattcatggcgatcaggtgctggctcagccgctgggtgctgaccgtaaaggtcgtcgtgaagcgcgtattgtccgcgtactggtgccaaaaaccagccagattgttggtcgctactttaccgaagcgggcgtcggctttgtggttcctgacgacagccgtctgagcttcgatatcttaatcccgcccgatcagatcatgggcgcgcggatgggctttgtggtcgtagtcgaactgactcagcgtccgactcgccgcaccaaagcggtgggtaaaatcgtcgaagtgctgggcgacaatatgggcaccggcatggcggttgatatcgctctgcgtacccatgaaattccgtacatctggccgcaggctgttgagcaacaggttgccgggctgaaagaagaagtgccggaagaagcaaaagcgggccgtgttgatctgcgcgatttaccgctggtcaccattgatggcgaagacgcccgtgactttgacgatgcagtttactgcgagaaaaaacgcggcggcggctggcgtttatgggtcgcgattgccgacgtcagctactatgtgcgtccgtcaacgccgctggacagagaagcgcgtaaccgtggcacgtcggtgtacttcccttcgcaggttatcccgatgctgccggaagtgctctctaacggcctgtgttcgctcaacccgcaggtagaccgcctgtgtatggtgtgcgagatgacggtttcgtcgaaaggccgcctgacgggctacaaattctacgaagcggtgatgagctctcacgcgcgtctgacctacaccaaagtctggcatattctgcagggcgatcaggatctgcgcgagcagtacgccccgctggttaagcatctcgaagagttgcataacctctataaagtgctggataaagcccgtgaagaacgcggtgggatctcatttgagagcgaagaagcgaagttcattttcaacgctgaacgccgtattgaacgtatcgaacagacccagcgtaacgacgcgcacaaattaattgaagagtgcatgattctggcgaatatctcggcggcgcgtttcgttgagaaagcgaaagaaccggcactgttccgtattcacgacaagccgagcaccgaagcgattacctctttccgttcagtgctggcggagctggggctggaactgccgggcggtaacaagccggaaccgcgtgactacgcggagctgctggagtcggttgccgatcgtcctgatgcagaaatgctgcaaaccatgctgctgcgctcgatgaaacaggcgatttacgatccagaaaaccgtggtcactttggcctggcattgcagtcctatgcgcactttacttcgccgattcgtcgttatccagacctgacgctgcaccgcgccattaaatatctgctggcgaaagagcaggggcatcagggcaacaccactgaaaccggcggctaccattattcgatggaagagatgctgcaactgggtcagcactgttcgatggcggaacgtcgtgccgacgaagcaacgcgcgatgtggctgactggctgaagtgtgacttcatgctcgaccaggtaggtaacgtctttaaaggcgtaatttccagcgtcactggctttggcttcttcgtccgtctggacgacttgttcattgatggtctggtccatgtctcttcgctggacaatgactactatcgctttgaccaggtagggcaacgcctgatgggggaatccagcggccagacttatcgcctgggcgatcgcgtggaagttcgcgtcgaagcggttaatatggacgagcgcaaaatcgactttagcctgatctccagcgaacgcgcaccgcgcaacgtcggtaaaacggcgcgcgagaaagcgaaaaaaggcgatgcaggtaaaaaaggcggcaagcgtcgtcaggtcggtaaaaaggtaaactttgagccagacagcgccttccgcggtgagaaaaaaacgaagccgaaagcggcgaagaaagacgcgagaaaagcgaaaaagccatcggcgaaaacgcagaaaatagctgcagcgaccaaagcgaagcgtgcggcgaagaaaaaagtggcagagtgatcaataccctctttaaaagaagagggttagattgctgacaaaatgcgctttgttcatgccggatgcggcgtgaacgccttatccggcctacataatcacgcaaattcaatatattgcagagatcatgtaggccggataaacgtagtgcatcaggcaaaacgtaaacaacgagtacattaatgagcgaaatgatttacggcatccacgcagtgcaggccctgctggagcgcgcccctgaacgttttcaggaagtctttattttaaaaggccgtgaagataaacgtctgttaccgctgattcacgcccttgagtctcagggcgtggttatccagttggcaaaccgccaatatctcgacgagaaaagcgacggtgccgtgcatcagggcattatcgcccgcgtgaagccaggacgtcagtatcaggaaaacgatctgccggatctgatcgcttcgctcgatcaaccgttcctgctgatcctcgacggcgtaaccgatccgcacaacctcggcgcgtgcctgcgtagtgcggacgccgcaggcgttcatgcggtgattgtgccgaaagatcgctccgcacagctcaacgctacggcgaaaaaagtagcctgcggcgcggcagaaagcgttccgctgattcgggtgactaaccttgcgcgcaccatgcgtatgttgcaggaagagaatatctggatcgtcggtacggcaggcgaggcggatcatacactctatcagagcaaaatgaccggacgcctggcgctggtgatgggtgcggaaggtgaaggtatgcgtcgcctgactcgtgaacattgcgatgagttgatcagcatcccgatggctggaagcgtttcttccctgaacgtttcggttgcgaccggaatttgcttatttgaagcggtgcgccagcgcagctaatttctcagaattatgaaaagccatccagatttggatggtttttttttgtctatagctggtaagataattacgtattgcaaatattcattttattaatatttaaacttaatctatatggaataatatatgacatggaatccgttggcgctagcgacggcgctgcaaactgtacctgaacaaaatattgatgtaacaaatagcgagaacgcattaattattaaaatgaatgattatggcgatttgcaaatcaatattctttttacttcccgccaaatgattatcgaaacctttatttgtccggtgagtagtatcagcaatccagatgaatttaataccttcttattaagaaatcagaagatgatgccgttgtcatcggtagggatctccagcgtacaacaggaagagtattacattgttttcggggcgttatcgcttaaatcttctcttgaagatatcctgcttgagataacctcgctggtagataacgcattggatctggctgaaattacagaagaatattcacactaattacaaggacgggtatttatgggaattttaaaaagtttatttacgctggggaaatcgtttatctcccaggcggaagaatccattgaagaaacccagggcgtgcgcatgctggaacagcatattcgtgacgctaaagctgaactcgataaagccggaaaatctcgcgttgatctgctggcgcgggtgaaattaagtcacgataagctgaaagatttacgtgagcgcaaagccagtctggaagcccgtgcgctggaagcgttaagcaagaacgttaatccgtcgttgattaacgaagttgctgaagaaatcgcgcgccttgagaatctcattaccgctgaagagcaagtgttgtcgaatctggaagtctcccgtgatggcgtggaaaaagcagttacagcgacagcgcagcgtatcgctcagtttgagcagcaaatggaagtcgttaaagccactgaagccatgcagcgtgcacaacaggctgtaacaacctctaccgttggcgcatcttccagcgtttcgacagcggcagaatccttaaaacgcctgcaaacgcgtcaggccgaacgtcaggctcgcctggatgctgccgcacagttggagaaagtcgcagacggtcgcgaccttgacgaaaagctggcggaagccggaattggcggtagcaataaaagtagcgcccaggatgtattagcaagactgcaacgccaacagggcgagtaatttttttgccagcctcgctaaaaggctggcaactattttaaggataaaatatgtctggttttttccagcgtctgtttggcaaggataataagccagctatcgctcgtggtccgctgggacttcatctcaatagtggctttacgctcgacacgttagcgtttcgtttgctggaagatgaattgctgattgcgctgccgggtgaggaatttacggtagccgccgtcagccacatcgatctgggcggcggtagtcagattttccgctactacacttcaggcgatgagtttctgcaaatcaataccaccggcggcgaagatattgatgacattgatgatatcaagctctttgtctatgaagagagctacggtatcagtaaagagagtcactggcgcgaggcgatcaacgccaaagcgatgggagcaatgaccttaaactggcaggaaaaacgctggcagcgattttttaacagcgaagaaccgggaaatatcgaacccgtctacatgctggaaaaagtagaaaatcaaaaccatgccaaatgggaggtccataattttaccatgggctaccaacggcaagtaaccgaagatacttacgaatatttgctgctaaatggtgaggaatcttttaacgatctcggcgagccagagtggttattttcgcgcgcgttgggtgtcgatatcccgctgacatcacttcatattattggttaattacaaggacgtttacaatgcatatactggattcacttcttgcctttagcgcctatttttttattggcgtggctatggtgattatttttctgtttatctattctaaaattacaccgcacaacgaatggcagttaatcaaaaacaataataccgcggcgtcactggcgttcagcggtacattgttgggttacgttatccccttatccagtgcggcaatcaatgcggtgagtattccagactatttcgcctggggcgggattgcactggtgattcagttactcgtttttgctggtgtcagactttatatgcccgcattaagcgaaaaaattattaatcacaataccgcagcaggaatgtttatgggaaccgccgcgctggctggcggtatttttaacgcagcttgtatgacatggtaatggacgatcatggccagaaaacgcaaatcaagaaataacagtaaaattggtcacggagcgattagtcgcattggtagaccgaataatccttttgaaccgtgccgcaatcgctacgcacaaaaatacttaacgttggcgctaatgggcggtgccgcttttttcgtattgaaaggttgtagcgatagtagcgatgtcgataacgacggcgacggaacgttttacgcgacagtgcaggattgtattgatgacggtaataatgccgacatttgcgcgcgtggctggaacaacgccaaaacggcattttatgccgatgttccgaagaatatgactcagcagaactgtcagtctaagtacgaaaattgctactacgacaatgttgaacagagttggatcccggtcgtttctggatttttgttaagccgggttattcgtaaagatcgcgatgagccgtttgtttataacagcggcggttcctcttttgcttcgcgcccagtctggcgcagcacttctggtgattactcctggcgctccggttctggcaaaaaagagtcttactcttcgggcggctttaccaccaaaaaagcgtctaccgtttctcgcggcggctatggtcgttcttccagcgcccgtgggcattggggaggctaatcatgctgagacacaacgttcctgtgcgacgggatctggaccagatcgccgctgacaacggtttcgactttcatatcatcgacaatgaaatctattgggatgagagtcgggcttaccgttttactctgcgccagattgaagagcagatcgaaaaaccgactgcggaactgcatcagatgtgccttgaggtggtggatcgcgcggtaaaagatgaagagatcctgacgcaactggcgatcccgccgttgtactgggatgtgatcgctgaaagctggcgcgcccgcgatccttcgctgtatggacggatggattttgcctggtgtggcaatgcgccggtgaagctgctggagtacaacgccgatacgccaacttcattgtacgagtcggcttatttccagtggctgtggctggaggatgcccggcgcagcggcattattccgcgtgatgccgatcagtacaatgctattcaggaacgcctgatttcacgctttagcgagctttacagtcgggaaccgttttatttttgctgctgtcaggacaccgatgaagacaggagtaccgtgctgtacttgcaggactgcgcccagcaggcagggcaggagtcgcggtttatctacattgaagatctcggtttgggcgtcggcggcgtactgaccgatcttgatgataatgtcatccagcgtgcatttaagctgtatccgctggagtggatgatgcgtgacgataacggtccgctgctgcgcaagcgtcgcgagcaatgggtggagccgttatggaaaagtatcttgagtaataaagggctaatgccgctgctttggcgcttcttccctggtcatcctaatcttcttgcgtcctggttcgatggcgagaaaccgcagattgccgctggcgaaagctatgtgcgtaaaccaatctattcgcgcgaaggcggcaacgtcaccatttttgacggcaagaataacgttgttgaccacgctgatggtgattacgccgatgaaccgatgatctaccaggcgtttcaacctctgccgcggtttggcgatagctacacactcatcggtagctggattgtcgatgatgaagcgtgcggaatggggatccgtgaagataacacactgatcaccaaagacacctcacgtttcgttccgcattacattgctggataagaatgttttagcaatctctttctgtcatgaatccatggcagtgaccatactaatggtgactgccattgatggagggagacacagtgcactggcaaactcacaccgtttttaatcaacctataccattaaataacagcaacttatacctgtctgatggcgcgctctgcgaagcggtaacgcgtgaaggtgctggctgggatagcgattttctagccagtattggtcagcagttaggaacggctgaatcccttgaactggggcggctggcgaatgtgaatccgcctgaattattgcgctacgatgcgcaaggacgccgtctggacgatgtgcgttttcaccccgcctggcacctgctgatgcaggcgctatgtaccaatcgggtgcacaatcttgcctgggaagaagacgctcgctccggcgcatttgtggcgcgcgcggcgcgttttatgttacatgcgcaggttgaggcagggtcgttatgtccgataaccatgacctttgccgccacgccattgttgttacagatgttacccgcgccgtttcaggactggaccacgccgctattgagcgatcgctacgattctcacttattgccaggtgggcaaaaacgcggtttgttgattggcatgggaatgacggaaaagcagggcggttccgatgttatgagcaacaccacccgtgcagagcgtctggaagatggctcttatcggctggtggggcataaatggtttttctcggttccgcaaagcgatgcgcatctggtgctggcgcagaccgcgggtggtctgtcctgcttttttgtgccgcgctttttgcctgacgggcaacgcaacgcgattcgcctcgagcggctgaaagataagctgggtaatcgctctaacgccagttgcgaagtggagtttcaggatgccattggttggttgttggggctggaaggggaaggaattcgtctgatcctgaaaatgggtgggatgacgcgttttgattgcgccctgggtagccatgccatgatgcgccgtgcattttcgctggcgatttatcatgcacatcaacgccatgtttttggtaatccattgatccaacagccccttatgcgtcatgtcttaagtcgcatggcacttcagcttgaagggcaaacggcgttgctgtttcgtcttgcgcgagcgtgggaccggcgtgccgatgccaaagaagccctgtgggcgcgtttatttacgcctgcggcaaaatttgtgatctgcaaaagaggtatgccgtttgtggccgaagcgatggaggtgctgggcggcattggttattgcgaggagagtgagctgccgcggctttaccgggagatgccggtaaacagtatttgggaaggttccggcaatattatgtgcctggatgtgttgcgcgttctcaataagcaagcgggcgtatacgacttattgtcggaagcatttgtggaagtgaaagggcaggatcgctattttgatcgcgcggttcgtcgtttacagcagcagctgcgtaagccagctgaagaactggggcgagagattactcatcagctattcctgctgggctgcggtgcgcaaatgttgaaatatgcttctccgccaatggcgcaggcgtggtgtcaggtgatgttagatacgcgcggcggcgtacggttgtcagagcagatccagaatgatttattgctgcgggcgacggggggagtgtgtgtgtaagcgtatacgactgatgcgacgctggtttcgattaactaaatgaaatatgtgaaaattgtaggccggacaaggcgctcgcgccgcatccggcattgttcatttgctgtagatgacactcatgcatacagtatcgcctgtacgcgccagttatcaggctgctggtcttcgtacatggtaataatgcggtaccatgacgcaccttgttcatcggcctttaacgccacgatacgttccacgtcctgcggatcccctgaaatattgctaactgagatctgacctatttcattcaggcccgtcacgcagtcagcactggcgaattctgcagactgtgccgtggcgctcgcaggataagtcactaattgcagcgagggtgaggcaagtaattgtttcatcgtcagctccatttttcgtttccccacatgttgcagggcattccatcgcggtaataaacgcccaggcttccagccggtaatttattgtgcacaggtaaacgcatagggacgcaaagcaatgtaaagctgactatgtaagttgtctgatttatttacggtacaaaatggcttgtgaataccactgtcctgtcacgatggtttcgtccaccatgacgacaacgtaataatcagcttttgcagcgacagctttcgctttgatttctgctaatgcgtcatccggagaaccccgaaccatcgtgcttacgctacctattcgctgtaacccttgcgtctggtcgcggcgaatctcttgcggatggtccgttactggcggtgctggctgtggcgtaccttgcagtgcgctacaggcacttaacatcaacaccaataataaactggcaaaccggtaaataacgctattacgtttcctgctaaccatagtgtagtgccttattaatttaactttgggggaatgttcccgaattgttacctggtacgcgattttcgaatgaaaacgtgacgaaagcgtaacccacatctcaacattatgaactaataccgccagcagaaacttgtgctaaggatttcttcatgtcataccagacaaaaaggagagacagatgattgaaatagaatcacgcgagctggcagatattcccgttcttcatgcttatcctgtcgggcaaaaagataccccgttaccgtgcgtaattttttatcacggctttacttcatccagtctggtgtatagctattttgccgttgcgctggcgcaggctggtttgcgggtgatcatgccggatgcgcccgatcacggtagccgttttagtggtgacgcagcgcggcggttaaatcaattctggcaaatcttgctacaaagtatgcaggaattcactactttacgtgcggcaatagccgaagaaaactggctgcttgatgaccgtctggcagtcggtggcgcgtcgatgggcgcgatgacggcactggggattaccgctcgccaccccacggtgagatgtaccgccagcatgatgggatcgggctattttacatcactcgcccgttcactgtttccaccgctgatacctgaaacggcagcacagcagaatgaattcaataacattgtcgcgccactggcagagtgggaagcgacaaaccacctggaacaacttagtgacagacctctactgctgtggcatggcctcgacgatgacgttgtgcctgccgacgaatcactacgtttgcagcaggccttaagcgagacgggacgggataaactgctaacctgttcatggcagccaggcgtgcgtcaccgcattacgcctgaggcgttagatgctgccgtgacatttttccgccagcatctttaaacacgcagaatgctgaccccttgcgcttccagttgttgcaggatttccgggttagcatttttgccggtgataagcatatcgatttgatcggcacggctaaaaagcattcccgcgcgttcgccaatcttactgctatcaaccagtaccaccagtttccctaccacgctcagcatcttctgctctgccattgctgtcagcatatcggttttatacaacccttctgcggtcagcccttttccgctggtaaacatccagtgcccggcatagagactgttttcgctgccctgcgggcttaaagtgatggactgacttttgttgtactgtccgcccataatgatcacgctgtcatgttcttgatcgatcaggtaatttgccagcggtagataattagtgatgatttgcactggcttgccacacatttcccgcccaagcagaaacgcggtggagccgcagttgatgactacgctttcgcccggattaaccagctgcgaggccgctttagcgatacgtactttttcatcgtgattctgcgcctgatgcagattcatcggcgtccagcgcgggcgctgttgggtaatagcttctgcgccattgcgcacttttttcagtttgccgctttcgtcaagtttattgatatcgcgtcgcgcagtggcaggcgaaattcccagacgctcaacgactttctcaacggtcacaaagcccaattgtgcgagcatttccaggaggatttgatgtctttgtgcttcagtcatgagctattccgataaaatttgatttttttagatgatatttgaaatagccaggaaatactacgccggatagcgcgaacttctccacgctacccggtataaacgacagattacaggaatgacttgaacggcagatccggttcaatagtgaagcaatcatcgaaaccgcgcggatagtggtactcgaagttgtctttatccagcggccaggtaaatttgccacccacctgccagataaacggcttgaagccatacttcaggcgatcttttttcatctcccacagcacgcggatctcttgcggatcggcctggaagtttgaccagatatcgtggtggaacgggatcactactttcgcattcagcgcttcacccatacgcagcatatcggcgctggtcattttgtcggtgataccgcgcgggttttcgccgtacgatcctaacgccacgtcgatctgatgttcgttaccgtgcttcgcataatagttagagtagtgggagtcgccgctgtgatacagggagccgccaggcgttttgaacaggtagttcaccgcgcgatcgtccatgccatctggcagtacgccagccgctttttgatcggcaggcagggtgatcagtgcagtacggtcgaaagcatcaagcgcatgaatttcaatgtctttcacttttactacatcgcccggtttgaccacgatgcaacgctctttcggtacgccccagccaatccacaaatccacacaggttttcggtccgataaacggtacgtcatctgcacaattctgcatcacggcagcagcgacgttaacgtcgatatgatcgttgtgatcgtgagtcgccagtaccgcgtcgatctggcgaatcgcaaacggatcaagaacaaacggggtggtacgcaggtttggctgcagttttttcacgccagccatgcgctgcatctggtgaccctgtttcattaacgggttaccgtgactttgtttgccagtgccgcaccagaaatcaacgcaaacgttggtgccaccttccgatttcaaccagatcccggtgcagccaagccaccacatcgcaaatgtgccaggagcgacctgttcttgttcaatttcttcattcaaccagctaccccactccgggaaagtgctcaggatccaggattcacgggtgatacttttcactttactcatcgccatttaccttcatgatagttcaattcgaatcaatatgtgattggttttgattaatcctgacactattttttcaggaaggcaatgaccattttttgactttttgccagggaagttgttgttgattttgagtatggaaagatttaatggaatgtgtaattcaattaactaaatgaatttaaatggataattgtttcgttgtgtgaatcccactctatccatgtggaattatttgcgggtcgcgtcacatttaatcataaataatcttgttgtgattacttttgaaaattagagtgagtgcacaacattccgggtgtgtggaatacccggttacctcttcttcaggagatcgttatggagatcctctacaacatctttaccgtgttttttaaccaggtcatgaccaatgccccgttgttgctgggtattgtgacctgtctgggctacatcctactgcgcaaaagtgtcagcgttattattaaaggcacgattaaaaccataattggtttcatgttgttgcaggcagggtccggcatcctcaccagcaccttcaaaccggtggtggcgaaaatgtccgaagtctacggcattaacggcgcaatttccgatacctacgcttcaatgatggcaaccatcgaccgcatgggcgatgcctatagctgggtgggttacgccgtattgttagcgctggcgctgaacatctgttacgtgctgttgcgtcgcattaccggcattcgcacaatcatgttgaccggccacatcatgttccagcaggccgggttgattgccgttacgctgtttatcttcggctactccatgtggaccaccattatctgtaccgcgattctggtttcgctctactggggcatcacttccaacatgatgtacaagccgactcaggaagtgacggatggctgtggtttctccatcggtcaccagcagcagtttgcatcatggattgcctataaagtcgcgccgttcctcggcaaaaaagaggagagcgttgaagacctcaaattgccgggctggctgaacattttccacgacaacatcgtctccacggcgattgtgatgaccatcttctttggtgccattctgctctccttcggtatcgacaccgtgcaggcgatggcaggcaaagtgcactggacggtgtacatcctgcaaactggtttctcctttgcggtggcgatcttcatcatcacgcagggtgtgcgcatgtttgtggcggaactctctgaagcatttaacggcatttcccagcgcctgatcccaggtgcggttctggcgattgactgtgcagctatctatagcttcgcgccgaacgccgtggtctggggctttatgtggggcaccatcggtcagctgattgcggttggcatcctggtcgcctgcggctcctcgatcctgattattcctggctttatcccgatgttcttctctaacgccaccatcggcgtgttcgctaaccacttcggcggctggcgtgcggcgctgaagatttgtctggtgatggggatgatcgaaatctttggttgcgtctgggcggtgaaactcaccggtatgagtgcctggatgggcatggcggactggtcgattctggcaccgccgatgatgcaaggcttcttctccatcggtatcgcctttatggccgtcatcattgtaattgcactggcttatatgttcttcgctggccgcgcgctgcgcgcagaagaagatgcagaaaaacaactggcagaacagtctgcttaataaggagttttgattatgaccgtacgtattctggctgtgtgtggcaacggacaaggcagttccatgatcatgaagatgaaagtggaccagtttttaacccaatcaaacattgaccatacggtaaacagctgcgcggttggcgagtacaaaagcgagttgagtggcgcggatatcatcatcgcttctacgcacattgcgggcgaaatcaccgtgaccggcaacaaatacgtggttggcgtgcgcaacatgctctctcctgccgactttggcccgaaactgctggaagtgatcaaagagcatttcccgcaggatgtgaagtaaggacgcgccatgaaattacgtgattcgctggcggaaaataaatccatccgcctgcaggctgaagcagagacatggcaggaagcggtgaaaatcggcgttgacctgctggtggcggcagatgtggtagagccgcgttactaccaggcgattctggatggcgttgaacagttcggtccttatttcgttatcgctccgggcctggcaatgccgcacgggcgtccggaagagggcgttaagaaaaccggtttctctctggtaacgctgaaaaagccgctggagttcaaccacgatgacaacgatccggtggatatcctcatcaccatggcggcggtcgatgccaatactcaccaggaagtgggcatcatgcagatcgtcaacctgtttgaagatgaagagaattttgaccgtttacgcgcctgccgtaccgagcaggaagtactggatctcattgaccgcaccaacgcggcagcttaagaaggaattgaacatgtcattaccgatgttgcaagtcgcgctggacaaccagactatggatagcgcctacgaaaccactcgcctgattgccgaagaagtcgacattatcgaagtgggcaccattctgtgcgtgggcgaaggcgtgcgtgcggttcgtgacctgaaagcgctctacccgcacaaaatcgtactggcagacgccaaaattgccgatgcaggcaaaatcctttcgcgtatgtgcttcgaagccaacgctgactgggtgacggtaatttgctgtgcggatatcaacaccgccaaaggcgcgctggacgtggcaaaagagtttaacggcgacgtgcagatcgaactgaccggttactggacctgggaacaggcgcaacagtggcgcgatgcaggcattgggcaggtggtttatcaccgcagccgtgacgcgcaggccgcaggcgtggcgtggggcgaagcggacatcaccgcgatcaaacgtctttccgatatgggcttcaaagtcaccgtcaccggaggcctggcgctggaagatctgccgctgttcaagggtattccgattcacgtctttatcgcgggccgtagtatccgtgatgccgcttctccggtggaagccgcacgtcagttcaaacgttccatcgctgaactgtggggctaaggagcggatatgttgtccaaacaaatcccgcttggcatctatgaaaaagcgctccccgccggggagtgctggctggaacgcctgcaactggcaaaaacgttaggcttcgattttgtcgaaatgtcggtagatgaaactgacgatcgcctgtcgcgcctcaactggagccgcgagcagcgtctggcgctggtcaatgcgattgttgaaaccggcgtgcgcgtgccgtccatgtgcctttctgctcatcgtcgtttcccgctgggcagtgaagatgacgcggtgcgggcgcaggggctggagattatgcgtaaagctatccagttcgcccaggatgtcggtattcgcgtgatccagctggcgggctatgacgtttactatcaggaagccaataacgaaacgcgtcgtcgtttccgtgacggcctgaaagagagcgttgagatggcaagccgcgcgcaggtgacgctggcgatggagatcatggattatccgttgatgagctccatcagcaaggcgctgggatacgcgcactatctcaacaatccgtggttccagctctacccggatatcggcaacctgtcggcgtgggacaacgatgtgcagatggagttgcaggccggaatcgggcatatcgtcgcggtacatgtgaaagacaccaaacctggcgtcttcaaaaacgtgccgtttggcgaaggtgtagtggatttcgaacgttgtttcgaaacgctcaaacagagtggctattgcgggccgtacctgattgagatgtggagcgaaacggcggaagacccggcggcagaagtggcgaaagcgcgtgattgggtgaaagcgcgcatggcgaaagcgggcatggtggaggcggcataatgcaaaagctaaaacagcaggtatttgaagccaacatggagctgccgcgctacgggctggtgacctttacctggggcaacgtcagcgctatcgaccgcgaacgcgggctggtggtgatcaagcccagcggcgttgcctacgaaaccatgaaagcggccgatatggtggtggttgatatgagcggcaaggtggtggaaggggagtatcgcccatcttccgacactgcgacgcatctcgaactctaccgtcgttacccgtcgcttggtggcattgtccatacccactccactcatgccaccgcatgggcgcaggcggggctggcgatcccggcgttaggcaccacgcacgccgactacttctttggcgacattccgtgtacgcgcgggttaagcgaagaagaggtgcagggcgagtatgaactgaacaccggcaaagtgattatcgaaacgctgggcaacgccgagccgctgcatacgccgggaattgtggtgtatcagcacgggccgttcgcctgggggaaagatgctcacgatgcggtgcataacgcggtggtgatggaagaagtggcgaaaatggcgtggattgcccgcggcattaacccacaactcaatcacatcgacagcttcctgatgaataaacacttcatgcgtaaacacggtcctaacgcttattacgggcagaagtagaacacgcgctgcggaaatttccttcctcgggagataactggtctaattccgcagccgtttttcaaaaaaaagccccctgcgaagggggcaaagcaaactatggcaatgtttcgttggttatacctggtgctagcgataaatatccgcgctggcgtgcatattgccgttactccccggttcccgcatcagaattacgtggtagtacgttgcgccttgcgcatctgtttcttcatttaatgcctgacgtgcttcgctttcagtggcgaaattatgattgatataaatcacgcctaagctttgcacatcgtccatatttctggcctggtggttattaatttcaatggctgcccatgtatttgcacttagcaaaagcacagccagaagggctaaaacacgactgaacatagatacctcctcgacggctgactttgtgtgctctcctctgtgatgatcttctgatttaattttaatcaatgataaagaagttgatggtgaccatttctgatgcagttgttcaaaaaaacaccatgatgaagtgtgatgaacttcaaatcagcgtgttagaggttaattgcgaaaggggagatttatttcggctctgcccttgagtttagcgaggcatacaagtactataacgcgtcatttttcagccgacctttaacacgttccttgcctccccgggattcggctgacccagacaggaggctgaataatccgtaaggagcaattcgatgcgtcattacgaaatcgtttttatggtccatcctgaccagagcgaacaggttccgggcatgatcgagcgctacactgctgccatcactggtgcagaaggcaagatccaccgtctggaagactggggccgccgtcagctggcttacccgatcaacaaactgcacaaagcacactacgttctgatgaatgttgaagctccgcaggaagtgatcgatgagctggaaactaccttccgcttcaacgatgccgttatccgcagcatggttatgcgtaccaagcacgctgttaccgaagcatctccgatggttaaagcgaaagacgagcgccgtgagcgtcgcgatgatttcgcaaacgaaaccgctgatgatgctgaagctggggattctgaagagtaatttctgatgaccaaccgtctggtgttgtccggcaccgtgtgcagggctccccttcgaaaggtcagtccatcaggaattcctcactgccagttcgtgcttgagcatcgttctgtgcaggaggaagccggctttcaccggcaggcgtggtgtcaaatgcccgttattgttagcggacacgaaaaccaggccattactcacagtataacggtcggcagtcgcataaccgttcaggggttcatttcatgccacaaggcaaagaacggactgagcaaaatggttttgcatgccgagcagattgaattgatagattctggagactagccatatggcacgttatttccgtcgtcgcaagttctgccgtttcaccgcggaaggcgttcaagagatcgactataaagatatcgctacgctgaaaaactacatcaccgaaagcggtaagattgtcccaagccgtatcaccggtacccgtgcaaaataccagcgtcagctggctcgcgctatcaaacgcgctcgctacctgtccctgctgccgtacactgatcgccatcagtaatcggtcacggtccattaatacgactttgagaggataaggtaatgcaagttattctgcttgataaagtagcaaacctgggtagcctgggtgatcaggtaaacgttaaagcgggctatgctcgtaacttcctggtaccgcagggtaaagctgttccagctaccaagaaaaacattgaattcttcgaagctcgtcgcgctgaactggaagctaaactggctgaagttctggcagctgctaatgctcgcgctgagaaaatcaatgcactggaaactgttaccatcgcgtctaaagctggcgacgaaggtaaactgttcggttccatcggtactcgcgacatcgctgacgctgtaactgcagctggcgttgaagtggctaagagcgaagttcgtctgccgaacggcgttctgcgtaccactggcgaacacgaagtgagcttccaggttcacagcgaagtattcgcgaaagtgatcgtaaacgtagtagctgaataattcgttattcaacgagacgtaaaaacgccgaccattggtcggcgttttgctttctatttttcgtcaggtattagtttcgcaagtagatccattcaccattctcttgtgtccataagtcaggatggtttgctggcgttagatacatacgagcgcaactgatgtctcgctcctgcggcactcgctcgaaacccaaacccgagtagattgcggctgaacttgataaggaacgcagaccaattttcaaatcatggggtaaatcagaatacgcgtttagcaatgcagcaatgatgaatccgagggcattagaaacgcctgtaacagtgcgaagttggtcgatataaagatcgattgttggtagttcagatgaccagcaattaggcatttgggcaggaagggttacaacgtatcctatcgtttggccggtatagtctggagtaccataaccaggtcccaaaaccacttcgtgtattgtgtatttactgttgggttcgaaggattcgacatcttgcaataaatatttcagttctgcggttaacctcgcacccgcgtaagctttattgtatttctgggcgtgaatattatctaatgtagcttcatggttccatccaaaagaattatcaccattcattgtgattccatcgtaagcattacacctcgtcgctaacttattgaatgcttgccagtctgagagatctagtttgtggatctcaacagtacgtctgccatcgcaattatgatctcttccacgatttgaaagtaatgtagcgcgtgcgtattgatgaaattttaattttactggtttgtcggtggacgaaaaacgagataaatatgcaggaaatgaataaatagtcgttggtaatgtcattgtaatgttacctgtttaatgtttttataaatatcgcagctgaatgttcacagaaaaaaatcgatattaataaaaataagtttgttttctgaagtggtgaaaatagcggatggtgaaagatattaatatcaaaaatcgctcattatggatataacgatgcacccggggagaaaatgacttccacgccttacaccgtacattcttgttgtgcggtatgtaattattctacgctgtcggtatcggtgtattcgttaatcagcaggttagccagccacaaaaagccattgagaaaattattgattttacatgggattattatattgctaatccttggtttttaaaaattgtgcatagtgaaaatcaaagtaaaggtgtgcattatgcaaaatcacagcgtctcttagaaattaaccatgcgcacttgcagttaatggaatccttattggatgaagggaagaaacacaatatttttaagccagatatcgacccattgcaggtgaatattaatattgctgcgcttggcggatattatttgatcaaccagcatacgcttggcctggtttatcacatcagtatggtttcaccccaggcactggaagccagacgtaaggtcatcaaagagacaatccttagctggcttttggttgacccttcatctaccgcgcacgaataaaactgccatccggctggcgggtgaacaggacctgttgattattccccgtatcaatggttaagcccgtcaccacgccgctggcgttctggcggattttcaccatctgcccgttttgcaaattactcagcggcttacccgcgccttctacctgcgccattgcatagacatcggtagcgggcagtccgtggtcgcggaacagctgcgccatcgttttaccgggttcgacacggtaagagcgccattgattatcaattccgctatctggctggaatggttgcgtttgggtagtttgcggctgctcttctggctggccttcctgtataggttctggagcgaccggagccacctgatcaggatcattttgtggggtaactaattgcgcccgcagctgttcttctgtcggcggttgtgattgcgactgaatatctaactgcgcttcacgcgtcaccaccggcgcgttgggcgtatcatcagatggaagcagaaatccgaccaccaatacaatggcggcaataatgatcccccgacgatgcatcggcggcagcgggtccatgaagcgaaaattgtccggcgcgtgccagactttctccagggttggttttagttcaaagcgcccgggcatggtttcctcctgctccgcgtcttgttcctcaatcatagcctatgaataagctaacgctatgatgtccgtggtaaacccgcctttattatattcatacgggatattgctattgtttctttttccctgggatttgtcatcattcccgcgacaaagttttacccaaagaagtgtggctgatatgctgcccgctactttataccctaagaaaggaaatacgatgaccaccccaacttttgacaccatcgaagcgcaagcaagctacggcattggtttgcaggtagggcaacaactgagtgaatctggcctggaagggctgctgccagaagcactggttgcaggtattgccgatgcgctggaaggcaaacatccggctgttccggttgatgtggtgcatcgcgcgctgcgtgaaatccacgagcgcgccgatgccgttcgtcgtcagcgtttccaggcgatggctgctgaaggtgtgaaatacctggaagaaaacgccaaaaaagaaggtgtgaatagcaccgaatctggcctgcaattccgcgtgatcaaccagggtgaaggcgcaattccggcacgtaccgaccgcgttcgtgttcattacaccggtaaactgatcgacggcaccgtgtttgacagctccgttgctcgtggtgaacccgctgaattcccggttaatggcgtgatccctggctggattgaagcactgactctgatgccggtaggttctaaatgggaactgactatcccgcaggaactggcatatggcgagcgcggcgcaggcgcatccatccctccgttcagcaccctggtgtttgaagtcgaactgctggaaatcctctaagcagcgcattctgttcccctcgaacgagaggggagcaggcattcagcaataaacccttcagtttgccaaacggcgctattttgtgttgcaaagaccccgtaagcgtgtatttttgtgagctgtttcgcgttatcaccgtgatatgacactcactttaaacataaaattaacattagatctaaatcttagtattcatcccgcgtattgttacctaatatcgatgagtcccgatacagattcgtcgtatcatagactgactaaaggccgtagagcctgaacaacacagacaggtacaggaagaaaaaaacatggtagatcaggtaaaagtcgttgccgatgatcaggctccggctgaacagtcgctacggcgcaatctcacaaaccgacatattcagcttattgccattggcggtgccattggtacggggttgtttatggggtctggcaaaacgattagccttgccgggccgtcgatcattttcgtttatatgatcattggttttatgctctttttcgtgatgcgggcaatgggggaattgctgctttcgaatctggaatacaaatcttttagtgacttcgcttccgatttactcgggccgtgggcaggatatttcaccggctggacttactggttctgctgggttgtaaccggtatggcagacgtggtggcgatcacggcttatgctcagttctggttccccgatctctccgactgggtcgcctcgctggcggtgatagtgctgctgctgacgctcaatctcgccaccgtgaaaatgttcggtgagatggagttctggtttgcgatgatcaaaatcgtcgccattgtgtcgctgattgtcgtcggcctggtcatggtggcgatgcactttcagtcaccgactggtgtggaagcgtcattcgcgcatttgtggaatgacggcggctggttcccgaaaggtttaagtggcttctttgccggattccagatagcggttttcgctttcgtggggattgagctggtaggtacaacagctgcggaaaccaaagatccagagaaatcactgccacgcgcgattaactccattccgatccgtatcattatgttctacgtcttcgcgctgattgtgattatgtccgtgacgccgtggagttcggtagtcccggagaaaagcccgtttgttgaactgttcgtgttggtagggctgcctgctgccgcaagcgtgatcaactttgtggtgctgacctctgcggcgtcttccgctaacagcggcgtcttctctaccagccgtatgctgtttggtctggcgcaggaaggtgtggcaccgaaagcgttcgctaaactttctaagcgcgcagtacccgcgaaagggctgacgttctcgtgtatctgtctgctcggcggcgtggtgatgttgtatgtgaatcctagtgtgattggcgcgttcacgatgattacaaccgtttccgcgattctgtttatgttcgtctggacgattatcctttgctcgtaccttgtgtatcgcaaacagcgtcctcatctacatgagaagtcgatctacaagatgccgctcggcaagctgatgtgctgggtatgtatggcgttctttgtgttcgtggtcgtgttgctgacactggaagatgacactcgccaggcgctgctggttaccccgctgtggtttatcgcgctggggttgggctggctgtttattggtaagaagcgggctgctgaactgcggaaataaccgcattatcatgctggatggcgcaatgccatccagcttttagatcactcacccgccagcgcgcgtgggaacagtacattgttttccagactgatgtgatccatcaggtcatcaatcagttcattaatgccgttatacatcgctttccaggtggtgcaggcttctggcggcggtgtgacgttattggtggtgtgtttaatcacttccagcagttcgcccgcttcatcgtgctcgctttccattacgctgattggccccattgcctggctgcccatgccttgtttgatcatcgggaagaggatctgctcttctttcatcatgtggctggaaagctcttcatgcagcatggtcaggtattttgtcagcccttttggcacgctcggtttgtcggcgtgaacgcgctcgactttagtcgcttgcagaatcagctccggcagttgctcgcggtgacgatcgtggtagcgcacgatgatatggtcgatgatttctgccagcggggcgctacgccagtctttctcaatcggttgttcagcgagctttgccagttcagcttcaatgacctcaacatccagttctttacgtgccgccgcgcgcgccagcgtctgcttaccgccacagcagtaatccatatcatatttacgaaacagagctgaagcgcgaggaatagagagcgccagttcacctaaaggttggtcgcgataagccatagctgatacctcattcttaataagataagatgtattttaaatgcatctttaaggcaaaagctataacccttacgtagcagaggcttatttaactcactgccagcgtgtcaactttctgagacagattcagttaaaggtttttctggttttgctctgaccgcgatgaccacgccaatcactaacagcgcgataccgctcagcgtcattagcggcggcatttgctggcggagtaaaaaggtgtacagcaaacctgccagcgtttcgaaaacaatcagcggcccgagaatcactgtcggtaatagctggctggcgacgttccagcagagtgcgccaacccatgagcaaagcacggctatcgcaaccatcagactaataaacaccagcggacgggggccaaagggtagggagaagtccggcgtttgcgtattcagccagtaacaagcgacgagatagccgataagtgaaaccggcagtgtgaccagcgcctgcgctgttgcccacatcatcggatgtttgtcgggattttcccgcagccagcgggcgttgcgcagggcataccacgcccagcagaccacggaaactaacgccagcacgatgccagaggtataacgtgcccagtcaaaatcggggagtccgtggtttaactcagcaatattcacacacgccaggccgatgccaatacaaatcagtgctggggcgagttttccccacgcgagtttgccgtcgcgctggctataaagcagattggcaaagacaggaatgaccaccggcagggtgccgataatcatcgtggaaacaggcgcgccagtacgttgaatggcactggcaaggcagaagtaatagatgaggttgcccatcatagtgagcatcaaggcggtaagccagtcgcgacgcgccaactgacgcagacgcacgcgtcccagccaggcaatgggcagcgcaattaaccctaacgccagataacgccccatcgactgcaacatcgccgggtattccggcacgatcaacggcccgacaaaaataagcccccacatcaaccctgctaacagggcgtacagcacgccgctaatcattactggcatccattgatctgtcagaagaaagttcaggaagcagacatgattgctcccggcatcccgtcattatcagagaggatgcgggaggatgccactttaattaactagttattaacattaaaaagatggcttacgctttcggctaacgttgtcgttgggtggccaatcaatttgctaagtgttttgctgtcatcaaacagaccgcctttcgatgcgccaacgtcagaatccgccagcatatccgccagtccgtcgggcagtccgacgcttttcagtgccgcggcgaaatcggcttcgctcagattttgataggtaacctgtttgccgctctgtttggtcagctctgccgctaactgtgtcaacgtccaggcactatcgcccgccagttcgtaaaccttgccttcgtgaccggcttcgctaatcacgcgtgccgcagctgccgcataatctgcccgcgttgctgaggcgattttgccatcgcccgccgcaccgataaatacgccgtgttccagtgctgccggggcgctggcgaggtagttttcgctgtaccagccgttgcgcagcagggtgtaaacgatgccagaatcagccagcattttctccgtctcgatgtgctcatcggcgaggccgagcggggaggtatctgcatgtagcaggctggtataagcgataaatttcacgccagccgcctttgcggcattaataacattacgatgctgcggggcacgttgacccacttcgctggaagagatcagcagtagtttttccactccctgaagtgcagatgtcagtgcggcttcatcgccgtagtcagcctgacgcacggtaatgccttgtgctgccagggcttgggcttttgccggattacgaacgatagccactatttggctggcaggaaccgttttcatcaaggattcaataacatagtgaccaagttggccagtggcaccagtaatagcgatcatgggaagtctccatcgttttgtcttgtgtttaaatacgctaacacctaaacttacttttagtaagtacgtacaaaaaggtaagtatgaaatgagtcaggttagcctgtcgcaacaactgaaagagggtaatctctttgcggaacagtgcccgtcgcgcgaggtgttgaaacacgtcaccagccgttggggggtgttgattctggtggcgctacgcgaaggtactcatcgctttagcgacctgcggcgcaaaatcggtggggtgagtgaaaagatgcttgcgcagtcgttacaggcgttagaacaggatggttttcttaaccgtatcgcgtatccggtggtgccgccgcatgtggaatatagcctcacgccgctgggcgagcaggtgagcgaaaaggttgctgcactggcggactggattgagttgaatttgcccgaggtgttggcggtgcgggatgaacgtgcggcataactgccggatgcgctgagcttatctggtctacggtgcatggcttgtagggcggataagatgcgccagcatcgcatccgccaataaatgccggatgcggttgatgatttataggccgaaaaagaagtgttttacttactcaaatccacctgataaatcgcaaacccgatatcatcggtcgcgactttattcatcggatactgccctttctctttaataaacgctgcggctttatctgacggagaggtttcgaaacggatatccagtttcttatcgccagctatcggtgctaaacgccagttgttatctgccgccgggtgaatttcccccgcacgtttcgactcatcagcaatccacgctgccagcaccgagcggttctcatccggtgaagcaaaagcgatatggctgtcgcccgtaccggcaaatttgccgccgtaagcgcgatagttattggtggcaaccaggaacatggcgttcggatcaatcggcttgccattaaaggtcaggttcttaatcctttccgcattggcattaatcatctggcactcgccgtcataacgggcgggctgggtaacatcaatctgataattcacaccatcaataacatcaaagttataagtgcggaaaccatcccagttgatgagtgactgtggtttcgtgctgttgggatcaatctggttaaactgtcccgcggagcactccagccactctttcacctctttaccgctggctttcaccacaatcagcgtattgggatagagataaagatcggcggcattacggaaggtcaactggcctttttccacctccacatagcttgccgggtcatttttgcgaccaccgactttaaacggtgcggcagctgaaagcaccggcagttttgccagatccggatcgccctgaatgtaatgctcgacatacgctttttgcgcgttgttcaccacctgcacggtcggatcgtcctgcaccagcgccagatagctatacatattgtcggcagatttaccgattggcttgctgacgaactggcgtgtggcatcgtgatcggctttgagtgtttctaccagcttgctgtcttccgccgcgagggattttttattagcgatgtcgtaaatcggtcgtgcttccgctttcgcctgcgtcacctgccatttaccgctgtcattactgagttgtaagtcgaccacaccaagatgatcgccccacatgcctggcattaccgccggaacaccattcagcgtgcctttggcgatatcagccccttcgatatcagcaaaatctttacctgggaaaacggcgtgagcatggccaaacataatggcgttaacgcccggaatttcactgaggtaataaactgagttttccgccatcactttatacggatcggcagatagcccggaatgtgccagaacgacaacaacatcggcacctttctcgcgcatttcaggcacgtatttgcgcacggtttcggtaatatcattcaccgtcactttcccggataaattagctttatcccagcccatgatttgtggtggcacgacgccaatatagccaatcttcagcgtctgtttttttccgtctttatcgaccacttcggtgtctttaattaaatacggtgtaaacattggctgtttggttctggcgtcaatgacgttggcatttacataagggaatttcgctcctgccagcgcatttttcaggtaatccagaccgtagttaaactcgtggttgccaagcgttccgacggtatagtccagcgtatttaatgccttatagaccgggtgaatatcacctgcttttaatcctttcgccgacatgtaatcggccagcggactcccctgaatcaaatcgccgttatcaaccagtacgctgtttttcacttcattgcgggcatcgttaatcaggcttgccgtacgtaccagtccgaatttttccgtggcggtgtctttgtaataatcgaaatccatcatgttgctatgcagatcagtggtttccatgatacgcagatcgaccgtcgctgcattcacactggcggcaatcagcgtggccaggagcgttgcgctaaacttaatcatcagggacatccttttatcatcgggaatacgaaagaaaagggagaataaacgtcttacttatagaacagtgaagaatgccacaattttacgctttgaaaatgatgacactatcacagttggcgcattcattaacgatagggtataagtaaaacaataagttaacaccgctcacagagacgaggtggagaaatgttagatcaagtatgccagcttgcacggaatgcaggcgatgccattatgcaggtctacgacgggacgaaaccgatggacgtcgtcagcaaagcggacaattctccggtaacggcagcggatattgccgctcacaccgttatcatggacggtttacgtacgctgacaccggatgttccggtcctttctgaagaagatcctcccggttgggaagtccgtcagcactggcagcgttactggctggtagacccgctggatggtactaaagagtttattaaacgtaatggcgaattcaccgttaacattgcgctcattgaccatggcaaaccgattttaggcgtggtgtatgcgccggtaatgaacgtaatgtacagcgcggcagaaggcaaagcgtggaaagaagagtgcggtgtgcgcaagcagattcaggtccgcgatgcgcgcccgccgctggtggtgatcagccgttcccatgcggatgcggagctgaaagagtatctgcaacagcttggcgaacatcagaccacgtccatcggctcttcgctgaaattctgcctggtggcggaaggacaggcgcagctgtacccgcgcttcggaccaacgaatatttgggacaccgccgctggacatgctgtagctgcagctgccggagcgcacgttcacgactggcagggtaaaccgctggattacactccgcgtgagtcgttcctgaatccggggttcagagtgtctatttactaaattcagatggcagaaacagtgtatttcctgattctgccatcctgatttctcccaacctaaaaagttataaataaaaagagattgtatttaaagtgcaaaaattcaattgctaataagttacattttaataatgagcgttttttgatagtttacttctatagtgagatatttaatggcgacataaagtaaccaaataaaataaggttgtcatatgttacccaggatcagacacaataattttattggtgcggtggagttatttgtaaagtcttcgtatacaaaaacacattcaaacaatttttttaacaacatccatcatgcatttaagaaaaaagattggatttcgaattatgatagcctgttaactttgagggagttctttcgttgcgcaactcagattgataaaagtggttatcaggtgctttcatcaaaaaatgaaactgttcacgccatggataagtttcttatcagtttcagccttaaagataacggtgccgaatatacaatgacattgcgaggtagtggatttgaatacgaagaaatacccataacaataaatgaatataactcattcatggatttcaaaaaccgtgaatttccgttagaacaaaacagacgattgtatgcctgggatattctacagaaaaaacagtctgacataccgaaaaggattaaaggttatattcaccaggcgattggtgacgtgtctttaggttatgccttattggaggatatagtaagcaaattaaaacggggtaaatttgaactccaaataccaggaggtggaattaaagaatgcgatggatggtatatttacgaaaaaataattgatgataattttgccatagtcatagaatctttgggctttgcgcttaaaatctatggaggggatgaacgttttcgtaatggttcctctgttgttttggaggatgaagattactctcttatttataattttctggttaatgcaggttgccaacaagtcgaattagccgaacaagtggatgcgatagtaagtgcgaatctggccgcagatagcgatattaccaaagaaaagatttgcgagaaatataaatcgaccattgaggcgtttaaaaaagagcaactagcgttaccagtattagttcggcgtaagaactcagagacttaattcccctatcccatagataacgataggggaaaattatttttgcagaatttatgttattgccattatttgagcaacttttgcagcaggtccatcacttgctgcacctcttccggtgtgagcgccccgtctttggcccattgcacgcgaccatccttatccagcaccactacagcggaactttcttcatccagctgccaggcaccgagcgcgacgccattgctatcgacaataaactgcgaccagggataaagctttttattactctccagactgctgcgcacaaacatccctgaacccggaatcgcgtcgtcggtgttaacaatggtggtggtctggtaacgatcgtgcggtaacttcgctgatttaatcgcttcaatcagcgtcgcgtttttctcttttgcagaggtgcgaccagcaatatgttgcagtactcgcacttttcccactaactgcgcgctgttccaggttttgtagctaaactgatctttatcaagcaccaactcgccccgatcggtaatgccaatcggcggcactcgctgaccggtttcgaactgatgtgcggaagccatcatcggcaacagcaggcaggtgagtgccagaatcttgcgtagggtcatggtgtttccttcttatgatatgcaggtgatccgaccacttgggtctgagttttaatcatatgtgctatttatcgaatttcccgcaagtgtgatgccagtttgcggtcaagcgcacaaatcatatgaaaaatgaatgcttatactgaagaccgcgcttcggtaaaaagataattctgaataattgtaacctttaggtaaaaaaagttatacgcggtggaaacattgcccggatagtctatagtcactaagcattaaaatttgcgcctcataatagttgggccgattgtggcaccgcacaggcgtaatactcagcaggagataacaatgaaaattttccaacggtacaacccacttcaggtggcgaagtacgtaaagatcctgttccgtggacggttatacatcaaggacgttggcgcttttgaattcgataagggtaagattcttatcccaaaagtgaaggataagctgcatttgtcagtgatgtccgaagttaaccgtcaggttatgcgtctgcaaacagagatggcttaaccaaagtgctatgcagtaaaaagtgctatgcagtaataagacggctcctgattcaggagccgttgatgtttctgggggttacgcgacgctttcttctttatctttagcgtcaggcagttttggcgaaagggcggtggccttgctgtcgatccgggtcaccagcagctggtcgatgcggtagttatcgatatccaccacttcaaatttgtagccggcgaatttcaccgaatcggtgcgtttcgggatcttacgcagcataaacatcataaagccgccgatggtttcgtagttgcccgactgcgggaactcgtcaatatccagcacgcgcatgacgtcgtcaattggggtgccgccgtcaatcagccatgagttctcatcacgggcgacaatctgctcttccagcccctgaccgaccagatcgcccatcagcgtggtcatcacgtcattgagggtgatgatccccaccaccagcgcgtactcgttcatgatcaccgcgaagtcttcacctgcggttttaaaactttccaacgcctctgaaagggttaacgtatccggcacaatcagcgtgttgcgaatttgtacgccgctgttcagtgccaggctttggttagccagcacgcggttcagcaggtctttagaatcgacataaccgatgatgtggtcaatatcttcattacagacgaggaacttagagtgcggatgttccgccaccttattcttcaggctttgctcatcttcgtggagatcaaaccaaatcacgttttcacgcggtgtcattgaagacggaacggtacgggattccagctcaaagacgttttcaatcagctcgtgttcctgtttacgtaacacgcccgccagcgcaccggcttccactaccgcgtagatgtcatcagaagtgatgtcatctttacgtaccattggcagtttgaaaatacggaagattatgttcgccaggccgttgaagaaccacaccagcggggtgcaaacgtacaggcagaagcgcatcgggttgatgatacgcaaagccacagcttctggcgcaatcataccgatgcgtttcggggttaaatccgcaaacaggataaacatgccagtcactaacgagaaagagagaataaagctcagttgctcagagagctctgccgacatatagcgggagaacaggctgtgaaaagctggagaaaatgccgcatcaccgacgataccgccgagaatcgccactgcgttcagaccgatttggaccacggtaaagaacatgccgggattttcctgcatattcagaacgcgttgggcatttatattgccttcatcagccagcagtttaagtttgattttgcgtgaggcggcaagcgagatctcggacatcgagaagaacgcacttacagcgatcaagcagagtatgactaaaatactgtttaacatatcttatccgacctttcaggccagatcctcggaaggggaagttgattaatttgtgtgaaatacacattgaaagccgattcgaagaaagtgaaccggcattttcagtggctagtatagcgtaaggtactgtaaagccgccagagggttaaaattcagacagctgaaaaatgcaaaactgcctgatacgctatgccgatcaggcctacgcagtccttgcaatatattgaatttggacgattttgtaggcctggtaagtcgtttacgccgcatcaggcatagacaaagagcactttatcaacaaactacatttgtacccgtaacgctatgcttccggcggcagacagacgccaattccgccaattccacagtaaccatacgggtttttatgcagatattgctggtggtcatcttcggcataataaaacggtgtggcgttagcgatttccgtggtgatgtgacgatcgtcatcggcggcaagcatcgccgcctgaaaacgttccagactggcgcgagctgcggcatcctgttctggggtcagcggataaatcgctgaacgatactgcgtgccgtggtcattgccctgacgcattccctgggcgggatcgtgattctcccaaaatacctgtagcaactgctcatagctgatgacggaaggatcgtaaacaatgcgtaccgcttcggcatgacccgtatcaccggagcacacttcccgataagtcggatttggcgtatagccgccggtatagcctgcggcggtgctgtaaacgccgggtaactgccagaacagacgctccacaccccagaaacaacccatcgcaaaaatggcaatctccattccgtcaggtacattggtcattgagtgaccgttgaccgcatgcagcgtggctacgggcatcggggtgttacgtccaggcagggcatcggcgggggaaaccagatgctttttatcaaataaactcatggtgtcgctctcccgaaaatcggtcattggggttaaggttgtaacaagaggcgtatttgcacacaataaccaccgtgaataggtctaaagtaaaacataagaaatatttggggtttagtctgctttttaatccatattactggatttttgttaagccgtttaacggcgttccaggggcaggaaaaaaggatattcaggagaaaatgtgcgctatatccgacagttatgctgtgtaagcttactctgcttaagcggatctgccgtcgccgcgaacgtccgtctacaggtcgaggggttatcgggacagctggaaaagaacgttcgtgcgcagctttctacgattgaaagtgatgaagtgacgccagaccgtcgctttcgcgcacgcgtcgatgatgccatccgcgaaggtctgaaagcgctgggttattaccagccgaccattgaatttgatctccgtccaccgccaaagaaagggcggcaggtattgatcgccaaagtcacgccaggcgtgccggtgttaattggcggcaccgatgtggtattgcgcggcggcgcgcggaccgataaagactatttgaaattgctcgatactcgcccggctattggcacggtactgaaccagggcgattatgaaaatttcaaaaagtccttaaccagcattgcgttgcgtaaaggttatttcgatagcgaatttaccaaagcgcagctgggcattgcgctcggcctgcataaagccttctgggatattgattataacagtggcgaacgttaccgctttgggcatgtgacctttgaaggatcacaaatccgcgatgaatacctgcaaaatctggtgccgtttaaagagggcgatgagtacgaatcgaaagatctggcagaactgaaccgccgactttctgctaccggctggtttaactcggtggtggtggctccacaatttgataaagcgcgcgaaacgaaagtattaccattgacgggcgtggtttcgccgcgaacagaaaacaccatcgaaaccggggtcggttactctacggacgtgggaccgcgcgtgaaagcgacgtggaaaaagccgtggatgaactcttatggtcacagtctgaccaccagtactagtatttccgcgccggaacagaccctcgacttcagctataaaatgccgctgctgaagaatccactggaacaatattatttggtgcagggcggttttaagcgcactgacctgaacgataccgaatctgactccactacgctggtggcttctcgctactgggatctctccagcggctggcagcgtgccattaacctgcgctggagtctcgaccactttactcagggtgaaattaccaataccacgatgctgttttatcctggggtgatgattagccgcacgcgttctcgtggtggcctgatgccaacctggggcgactcgcaacgctactctatcgactactccaacacggcctggggttcagatgtcgatttctccgttttccaggcgcagaacgtctggatccgcacactgtacgatcgccatcgttttgttacacgcggcacgctgggctggattgaaaccggtgatttcgacaaagtaccgccggatctgcgtttcttcgccgggggcgaccgcagtattcgtggctacaaatacaaatctatcgctccgaaatacgccaacggtgacctgaaaggggcctcgaagttgataaccggatcgctggaataccagtacaacgtgaccggaaaatggtggggcgcggtgtttgtcgatagtggcgaagcggtaagcgatattcgccgcagcgactttaaaaccggtaccggggtcggcgtgcgctgggaatcgccggtcgggccaatcaaactcgattttgccgtaccggtcgcggataaagacgaacacgggttacagttttacatcggtctggggccagaattatgagtttatggaaaaaaatcagcctcggcgtggttatcgttatcttactgttgctgggatcggtggcgtttctggtgggcaccaccagcggcctgcatctggtatttaaagcggcggatcgctgggtgccaggactggatattggcaaggtcaccggcggctggcgcgatctcaccttgtctgacgttcgttatgagcagccaggcgtggcggtaaaagcgggcaatctgcatctggctgtcgggcttgagtgcctgtggaacagcagtgtttgtattaatgatctggcgctgaaagacattcaggtcaacatcgacagtaaaaaaatgcctccttctgaacaggttgaagaagaggaagatagcggtccgctggatctctccacgccgtatcccatcaccctgacacgggtggcactggacaacgtcaacattaagattgatgacaccacggtatcggtgatggacttcacctccggcctgaactggcaggagaaaaccctgaccctgaaaccgacgtcgctgaaaggcctgctgattgctctgccgaaagtggcggaagtggcgcaggaagaagtggtcgaaccgaaaattgaaaatccgcagccggatgaaaagccgctcggcgaaacgctgaaagatctcttttctcgcccggtattgccggaaatgaccgacgtgcatttgccgcttaacctgaacattgaagagtttaagggcgagcagctgcgcgtgacgggcgacacggacatcaccgtgagcaccatgctgctgaaagtgagcagcattgacggcaatactaaactggacgccctggatatcgattccagtcaagggatcgtcaacgccagcggcacggcgcagctgtcagacaactggccggtggacatcactctcaacagtacactgaacgtggagccgttgaaaggtgaaaaagtgaagctgaaaatgggcggcgcgctgcgcgaacagctggagattggcgttaatctttccggtccggtggatatggatttacgcgcccagacgcgactggcggaagccggattgccgctcaacgtggaagtgaacagcaaacagctttactggccgttcactggtgagaagcagtatcaggcggatgatctgaaactgaaacttaccggcaaaatgaccgattacacgctctctatgcgtacggcagtgaagggacaggagatcccgcccgcgactattaccctcgacgccaaaggtaatgaacagcaggtcaatctcgacaaactcaccgtcgcggcgctggaagggaaaactgaactcaaggcgttgctcgactggcaacaggccattagttggcgcggtgagctaacgcttaacggcattaacaccgccaaagagttcccggactggccgtcgaaactcaatggcttgattaaaacccgcggtagcctgtacggcggcacctggcagatggacgtgccggagttgaagctgaccggtaacgttaaacagaacaaagtgaacgttgacggcacgctgaaaggcaacagttatatgcagtggatgatcccagggcttcatctggaactcgggccaaacagtgccgaagtgaaaggcgagctgggggtaaaagatctcaatcttgatgccaccatcaacgcgccggggctggataacgcgctgccggggcttggcggtacagcgaaagggctggtgaaagtacgcggcacggtggaagcgccacaactactggcagatatcaccgcgcgcggcctgcgctggcaggaactttccgtggcgcaggttcgcgtggaaggcgatatcaaatccaccgatcagatcgccgggaaactcgacgtacgcgttgagcaaatttcgcagccggatgtaaatatcaacctcgtcaccctgaatgccaaaggcagcgaaaagcagcacgagctacagttgcggattcagggggagcctgtctccgggcagcttaatctggcaggaagttttgatcgcaaagaagaacgctggaagggaactcttagcaatacccgcttccagacgccggttggcccgtggtcgctgacccgcgatattgcgctggattaccgcaataaggagcaaaaaatcagcatcgggccacactgctggcttaacccgaatgcggaactgtgcgtgccgcaaactatcgatgcgggggccgaagggcgtgcggtggtgaatctcaaccgcttcgacctcgccatgctgaaaccgtttatgccagaaaccactcaggccagcggtatcttcacgggtaaagcggacgttgcctgggacaccacgaaagaggggctgccgcagggcagtatcaccctttcggggcgtaacgtgcaggtaacgcaaaccgtcaacgatgcggcgctgcccgtggcgtttcagacactgaatctgacggcggaattgcgtaacaaccgtgccgaattgggctggaccatccgcctgaccaataacggccagtttgatggacaggtgcaggtgaccgatccgcaaggccgccgtaatcttggtggcaacgtcaatatccgtaacttcaaccttgcgatgataaaccccatctttacccgtggggaaaaagcagcggggatggtgagtgccaacttgcgtctgggtggtgatgtgcaaagcccgcagttgtttggtcagcttcaggttacgggtgtggatatcgatggcaactttatgccgtttgatatgcaaccgagccagcttgcggtcaactttaacggtatgcgctcgacgcttgccggtacagtacggacccagcagggtgaaatctacctgaacggtgatgccgactggagccaaattgaaaactggcgggcgcgggtaacggcgaaaggcagtaaagtgcggatcaccgtgccgccgatggtacgaatggatgtatcgccagatgttgtattcgaggctacaccaaacctgtttaccctcgatggtcgcgtggatgtcccttgggcgcgcatcgtggtgcacgatctgccggaaagcgcagtaggcgtctccagcgatgtggtgatgcttaacgataacctgcaaccggaagagccgaaaacggcgtcgattccgattaacagtaacctgattgtccacgttggcaacaatgtgcgcattgacgcctttggcctgaaagcgcggctgacgggcgatctcaatgtcgttcaggacaaacaagggctgggtctgaacgggcagatcaacatccctgaagggcgcttccatgcctatggtcaggatctgattgtgcgtaaaggtgagttactgttctctggtccgccagatcaaccgtatcttaatattgaagctattcgtaacccggatgctacagaagacgacgtaatcgccggagttcgcgtcactggtctggcggacgaaccgaaagcggagatcttctctgacccggcgatgtcgcaacaagctgccttgtcttatttgctacgtggacaagggctggagagcgatcagagcgacagtgcggcaatgacctcgatgctgattggtttgggggttgcgcaaagtggccagattgtgggtaaaatcggcgagacgtttggcgtaagcaatttagcgctcgacacccagggagtaggcgactcctcccaggtagtggtcagcggctatgtattgccaggtctgcaagtgaaatacggcgtgggtatatttgactctatagcaacactcacgttacgttatcgcctgatgcctaagctatatctggaagccgtgtctggtgtagaccaggcactggatttgctctatcagttcgagttttagcaatgcgaatatttgtctacggcagtttacgccacaaacaaggcaacagtcactggatgaccaatgcccagttactgggcgatttcagtatcgataactaccagttgtatagcctgggccactatccaggcgcagttccggggaacggaacggtacacggtgaagtttatcgtattgacaacgccacgctggccgaacttgatgccttgcgcaccaggggcggtgaatacgcgcgccagttgattcagacgccgtacgggagtgcatggatgtacgtttatcaacgacccgtcgatggattaaagctaattgaaagcggcgactggttagacagggataagtaaccatatgcatacgccaccttcgggtggcgttgttttttgcgagacgactcgcattctgttttgtaattccctcaccttttgcttttctctccgagccgctttccatatctattaacgcataaaaaactctgctggcattcacaaatgcgcaggggtaaaacgtttcctgtagcaccgtgagttatactttgtataacttaaggaggtgcagatgcgtattaccataaaaagatgggggaacagtgcaggtatggtcattcccaatatcgtaatgaaagaacttaacttacagccggggcagagcgtggaggcgcaagtgagcaacaatcaactgattctgacacccatctccaggcgctactcgcttgatgaactgctggcacagtgtgacatgaacgccgcggaacttagcgagcaggatgtctggggtaaatccacccctgcgggtgacgaaatatggtaaagaaaagtgaatttgaacggggagacattgtgctggttggctttgatccagcaagcggccatgaacagcaaggtgctggtcgacctgcgcttgtgctctccgttcaagcctttaatcaactgggaatgacgctggtggcccccattacgcagggcggaaattttgcccgttatgccggatttagcgttcctttacattgcgaagaaggcgatgtgcacggcgtggtgctggtgaatcaggtgcggatgatggatctacacgcccggctggcaaagcgtattggtctggctgcggatgaggtggtggaagaggcgttattacgcttgcaggcggtggtggaataaggtgtgtttatttatcgcgggcataaaaaaacccttactaaccgaagcccggcgttcagggttattacgccagaagaacttatttattctttgcgcgctcgaaggaggcaacgatttcagctttagcggcttctgcgttttcccaaccttcaactttcacccacttgcctttttcgaggtctttgtagtgctcgaagaagtgagcgatttgcgctttcagcagttcaggcagatcgttaacgtctttaatgtgatcgtattctttgctcagcttgctgtgcggaaccgcaaccagtttcgcatcttcaccggcttcgtcggtcattttcagaacgccaaccggacggcaacggatcacagaacccggctgcagcgggtacggagttgggaccagtacgtcaaccgggtcaccgtccagagacagggtgtggttgatgtaaccgtagttgcatggatagaacatcgcggtggacatgaagcggtcaacgaacagtgcgccgctctctttgtcgatttcgtatttgatcggatctgcgttagccgggatctcaataacaacgtagatgtcttccggcagatctttacccgcagggacgttgagtaagctcatgtctgtttcctttaaaaatatgtggcaaacaagtgccgagtattatagccaactcgcgccgaatgtcttcgcttgttttcgtcttcattttcctttttcaccagttttaagacggtatacagagcaggaaaatccataaccgtagccgcatttttcatagtgagatgaaagcgattacaaacttgtgattaacgttttatttacttttttgaagtgtgatgtaacgcaatctgttacataacgaattgtctatagttttttcgcgaacatcttttaaccaataataactaccccgacgaggacaaccctatgtggaaacgcttacttatagtctctgcagtctcggcagccatgtcgtctatggcgttggccgctccattaaccgttggattttcgcaggtcggatcggaatcaggctggcgtgccgcagaaaccaatgtggcgaaaagtgaagccgaaaagcgcggaatcacgttgaaaattgccgatggtcagcaaaagcaggaaaaccagattaaagcggtacgttccttcgttgcacaaggggtggatgcgatctttatcgctccggtggtcgcgacaggttgggaaccggtattaaaagaggcgaaagatgccgaaatcccggtattcttgctcgatcgttccattgatgtgaaagacaaatctctctatatgaccaccgtcactgccgacaacatcctcgaaggcaagttgattggtgactggctggtaaaagaagtgaatggcaaaccatgcaacgtggtggagctgcagggcaccgttggggccagcgtcgccattgaccgtaagaaaggctttgccgaagccattaagaatgcgccaaatatcaaaatcatccgctcgcagtcaggtgacttcacccgcagtaaaggcaaagaagtcatggagagctttatcaaagcggaaaacaacggcaaaaacatctgcatggtttacgcccataacgacgacatggtgattggtgcaattcaggcaattaaagaagcgggcctgaaaccgggcaaagatatcctcacgggttccattgacggtgtaccggacatctacaaagcgatgatggatggcgaagcgaacgccagtgttgaactgacgccgaatatggcaggtcccgccttcgacgcgctggagaaatacaaaaaagacggcaccatgcctgaaaagctgacgttaaccaaatccaccctttacctgcctgataccgcaaaagaagaattagagaagaagaaaaatatggggtattgagggttgctatgcctgatgccgattcgtaggccggataaggcgctcgcgccgcatccggcgatggtgcactgaagcctgatgcgacgcttaccgcgtcttatcatgcctactgggagcacgctttacaccgggggaaaccatgacgaccgaccaacaccaggagatcctccgcaccgaaggattaagtaaatttttccccggcgtcaaagcgttagacaacgttgatttcagcctgcgccgtggcgaaatcatggcgctgctcggtgaaaacggggcgggaaaatcaacgctaatcaaagcattaactggtgtataccacgccgatcgcggcaccatctggctggaaggccaggctatctcaccgaaaaataccgcccacgcgcaacaactcggcattggcaccgtctatcaggaagtcaacctgctacccaatatgtcggtcgctgataatctatttataggccgcgaacccaaacgcttcggccttctacgccgcaaagagatggaaaagcgcgccaccgaactgatggcatcttacggtttctccctcgacgtgcgcgaaccgctcaaccgcttttcagtcgcgatgcagcaaatcgtcgctatttgtcgggctatcgatctctctgccaaagtgctgatcctcgatgaacccaccgccagtctcgacacccaggaagtggagttactgtttgacctgatgcgtcagttgcgcgatcgcggcgtcagcctgatttttgtcactcactttctcgatcaggtctatcaggtcagcgatcggatcaccgtcttacgcaacggcagtttcgtaggctgtcgggaaacgtgcgagctaccgcagatcgaactggtaaaaatgatgctggggcgcgagctggatacccacgcgctacagcgtgccgggcgaacattgttgagcgacaaacccgttgccgcgttcaaaaattacggcaaaaaaggaacgatcgcaccgtttgatctcgaagtacgccccggcgagatcgtcggtctggctggattgctgggatcaggacgtaccgaaaccgccgaagtgatcttcggtatcaaacctgctgacagcggcacggcgttgatcaaaggcaaaccgcaaaacctgcgatcgccacatcaggcttcggtactgggcattggcttctgcccggaagacaggaaaaccgatggcatcatcgctgccgcctcggtgcgggaaaatatcatcctcgctctccaggcccagcgcggctggctacgtcccatttcccgcaaagaacagcaagagattgccgaacgctttatccgccagcttggcattcgcacaccttcaactgaacaaccgattgaatttctctccggcggcaatcagcaaaaagtgttgctttcacgttggctactgacccgaccgcaatttctgatcctcgatgagccaacccgcggcattgatgttggtgcccacgccgagatcatccgcctgattgaaacgctatgcgccgatggtctggcgctgctggtgatctcctccgaactggaagagctggtgggctatgccgatcgggtgattatcatgcgcgatcgcaaacaggtggcggagatcccgctggcagagctttccgttccggcgatcatgaacgccattgcggcgtaaggagaacagtgtgatgcctcaatctcttccggacaccactacgccaaaaaggcgctttcgctggccgacggggatgccgcagctggtagcactattgctggtgctgctggtcgatagcctggtagccccgcatttctggcaggtggtgcttcaggatgggcgtttgttcggtagccccatagacattcttaaccgtgcagctcccgttgcgttactggcgattggcatgacgctggtgatcgccaccggtgggattgatctctccgtaggggcggtgatggctatcgccggagccacaacggctgcgatgacggtcgcgggattcagcctgccgattgttttgttaagcgccctgggcaccggcatcctggcgggattgtggaacggcatactggtagcgatcctcaaaattcagccgtttgtcgccactctgatcctgatggtcgccgggcgcggcgtggcgcaactgatcaccgccgggcagatcgtcacgtttaactcgccggatctctcatggttcggcagtggatcgctgttgttcctgccaacgccggtcattatcgcggtgctgacgcttatcctgttctggctgttgacccgcaaaacggcgctggggatgtttatcgaagccgttggtatcaacattcgggcggcaaaaaatgccggggtaaacacgcgaatcatcgtcatgctcacttatgtgttgagcgggctgtgtgcggcgattgcgggcattatcgtggcggcggatattcgcggtgccgatgccaacaacgctgggttatggctggagctggacgccattctcgcggtggtgattggcggcggatcgctgatgggcgggcgctttaacctgctactttcggtggtgggggcgctgattattcaggggatgaacaccggaattttgctttcgggctttccgccagagatgaaccaggtggtgaaagcggtggtggtgctttgcgtgctgattgttcagtcgcaacgctttatcagtctgattaaaggagtacgtagccgtgataaaacgtaatttgccactgatgatcaccatcggcgtctttgtgttgggttatctttactgcctgacccagtttcccggttttgcttccacaagagtgatctgcaatatcctgaccgataatgcctttcttgggatcattgccgttggcatgacctttgtgatcctctcaggtgggatcgatctctccgtcggttcggtgatcgcctttactggcgtgtttctggcaaaagtgattggcgatttcggcctctcgccgctgctggcgtttccgctagtgctggtgatgggctgtgccttcggcgcatttatggggcttctgatcgacgccctgaagatcccggcatttatcattacgcttgcggggatgttctttttgcgcggcgtcagctatctcgtttcggaagagtcgattccgataaaccatcccatttatgacacgctctcaagccttgcgtggaaaatccctggcggcggtcgcttaagtgcgatgggactgctgatgttggcggtggtggttatcggcatattcctcgcgcatcgtacccgttttggtaatcaggtatacgccattggcggcaacgcaacgtcggcgaatctgatggggatttccactcgcagcaccactattcgcatttatatgctctccaccggactggcaacgctggcggggattgtcttctcgatttatacccaggccggatatgcgctggcgggcgtaggtgtggaactggatgctatcgcctcagtggtaattggcggtacgcttttgagcggtggcgttggaacggtattagggacgctttttggcgtggcgattcagggactgattcagacttacataaactttgatggcacgctgagttcctggtggacgaaaatcgccatcggtattttgttgtttatttttatagcattacagcgtggattaacggtgctgtgggagaatcgtcagagttcgccagtgacaagagtcaacattgcgcagcaataaaaacgcctctccgtgtggagaggcgcaggagattacgcgtccgggaactcacggataaagcgttcgacatcttcaaccatatggtcgttgccgacaaagaatgaacggcgctggtgcagggtttccgggatgatatccagaatacgctctttgccatcgctcgctttaccgcccgcttgttccgccaggaatgccatcgggttgcactcatacagcaaacgcagtttgccgtccgggtggctggcggtgcttgggtagagataaataccgcctttcagcaggttacggtggaaatccgcgaccagtgaaccgatataacgtgaggtataagggcggttggtggatttatcttcttcctggcagaatttaatgtacttcttcaccccgttcggaaacttaatgtagtttccttcgttgatggagtaggttttgcctttctccgggaagcgcatccgttcctggcacaggcagaaaacgccgagcgaaggatcgtaagtaaaggcgtgaacaccgcatccggtggtgtaaaccagcatggtagaggagccgtataccacgtaacctgccgcaacctgtttgttaccaggctggaggaaatcttcttccgttaccggcgtgccaacaggcgtaacgcggcggtagatggagaaaatggtaccgacagagacgttaacatcgatgttggacgagccatccagggggtccatcagcaccacgtattttgcgtgttcacagccttcaaagacgacaatctcatcttcttcttcagaggcaatgcccgcaacgatatcgcgtgctttcagtgcggctttcagtttttcattagcgaacaagtcgagtttctgctgaacctcgccctgcacgttctcagcaccgctggcacccaggatatcaaccagtcctgctttgttgatatcgcgatggataatcttggcgcccagttttattgccgacagcaaagcagtgagctcaccggtagcatgagaaaactcgtgctgcttttcgacaataaattcacctaacgttttcataaaactttccctgcaatgtttatggagtaaagcgaccgcaacaatcttaacaaataatctcaatgttgcgctcaggtgaatcgcgccagcaaattacggattatcctgaaatgcgtttctcacttgcccgacatatgcgtaaaatgagcggcagattaaaaaaggatagtgacgtatgcgcattcatattttaggaatttgtggcacatttatgggcggtctggcgatgctggcgcgccagttaggccatgaagtaacgggttcggacgccaatgtgtatccgccgatgagcaccttacttgagaagcaaggcattgagctgattcaggggtacgatgccagccagctcgagccgcagccggatctggtgattattggcaacgccatgacccgtggaaatccgtgtgtggaagcggtactggaaaaaaatatcccttatatgtcaggtccacagtggctgcacgattttgtgctgcgcgaccgctgggtgctggccgttgccggtacacacggcaaaaccaccaccgcgggaatggcgacctggattctggaacagtgtggttacaaaccgggctttgtaatcggcggtgtgccggggaactttgaggtttcggctcatctgggcgaaagcgacttctttgttatcgaagcggatgagtatgactgcgccttcttcgacaaacgctctaaatttgttcattactgcccgcgtacgctgatcctcaacaaccttgagttcgatcacgccgatatctttgacgacctgaaagcgatccagaaacagttccaccatctggtgcgtatcgttccggggcagggccgtattatctggccggaaaatgacatcaacctgaaacagaccatggcgatgggctgctggagcgagcaggagctggtgggtgagcagggtcactggcaggcgaaaaagctgaccaccgatgcttccgaatgggaagttttgctggatggcgaaaaagtgggcgaagtgaaatggtcgctggtaggcgaacataatatgcacaatggcctgatggcgattgcagcggctcgccatgttggtgtagcgccggcagatgccgctaacgcgctgggttcgtttattaatgctcgtcgccgtctggagttgcgtggtgaagcgaatggcgtcacggtatatgacgattttgcccatcacccgacggcgattctggcaacgctggcggcgctgcgtggcaaagttggtggtacggcgcgcattattgctgtgctggagccgcgctcgaataccatgaaaatggggatctgcaaagacgatctggcaccttcattaggtcgtgccgatgaagtcttcctgctgcaaccggcgcatattccgtggcaggtggcagaagtggcagaagcctgcgttcagcctgcacactggagtggcgatgtggatacgctggcagatatggtggtgaaaaccgctcagcctggcgaccatattctggtgatgagcaacggcggttttggtgggatccatcagaaactgctggatgggctggcgaagaaggcggaagccgcgcagtaattcggccttagccagatatagtatgcgtaggccggataaggcgttcacgccgcatccggcatttgagcatagtgcctgatgcgacgcttgatgcgtcttatcaggcctacaggtgcaccgtatccggcaaaccatactcacatcaacaacgaaaattacccttcgttctccgctaactcgcgcagatactggaaaatctggcgtgcggatttcggcggcttattcccttctttctctttcttcgcgttgcggatcagagtacgcagttgctgacgatcggcatcgggccacagatttaatacctcagcgatggcgtcatcaccttgatcgatcagacgatcgcgcaggttttccagtttatggaacagcaccacctgctggttgtgacggtttttcagcttatccagcgcctgacgaataggctctacgtcgcgctggcgcagcatcttaccgatgagctgcaactggcggcggcgaccttccatcttaatacgctgggcgagctcaatagccgcgcgcagatccgcatctaacgggatcttatccagcgcgtttttccccagatcaacaatttccgcgccaaggcgttttagctcctcggcatcacgtttaatttcacttttactgacccagataatttcatcgtcttcgtcttcgatgtcatcaccgggaacgtcgtcgagccagtcttcgggctgcttagtcatctcaggctccttaaaaaaagaggctaatgttaccagttaagatgcgcactgaaaaacggttctctgttagacttcagagaaactctctacattatggcacttgcaatgaaagtaatctctcaagttgaagcgcagcgcaagattctggaagaagcagtttccactgcgctggagttggcctcaggcaaatcggacggtgcggaagttgccgtcagcaagaccaccggcattagcgtaagcacgcgttatggtgaagtggagaatgttgaattcaatagcgatggcgcgctggggatcactgtttatcaccagaaccgcaaaggtagcgcatcatccaccgatttaagcccgcaggccattgcccgtactgtacaggcggcgctggatattgcccgttatacctcgccagatccctgtgccggcgtggcagacaaagagctgctggcctttgacgcaccagatctcgacttgttccaccctgcggaagtttccccggatgaagccattgaactggcggcccgcgcagaacaggcggcattgcaggcggacaaacgcatcaccaataccgaaggtggcagctttaacagccactacggtgtcaaagtttttggcaacagccacggcatgttgcagggttactgctcaacgcgtcattcgctctccagctgtgtaattgccgaagaaaatggcgatatggagcgtgattacgcctacaccattggtcgtgcgatgagcgatctgcaaacgccagagtgggttggggccgactgtgctcgccgtactttatcgcgtctgtcaccgcgtaaactctccaccatgaaagcgccagtcatttttgccaatgaagtggcaaccgggctttttgggcatctggtgggggcgatagcgggtggatcggtttatcgtaaatctaccttcctgctggattcgctgggtaaacaaattctgccggactggctgaccattgaagagcatccgcatctgctgaaagggctggcgtcgacgccattcgacagcgaaggtgtgcgcaccgagcgtcgcgatattattaaagatggcatcctgactcagtggctgctgaccagctactcggcgcggaaactggggctgaaaagcaccggacatgcgggcggtattcacaactggcggattgccggacaaggtctaagcttcgagcagatgctcaaagagatgggcaccgggctggtggtgacggaattgatgggccagggcgtgagtgccattaccggtgattattcccgtggtgcagcgggcttctgggtagagaatggcgaaattcagtatccggtgagcgaaatcaccatcgcaggtaatttaaaagatatgtggcgcaatattgtcaccgtcggtaacgatattgaaacacgcagtaatatacagtgtggttctgtgctgttgccggagatgaaaatcgccggacagtaaaaaaactggcgcgacctgccgcgctataaactaaaaaattacacaaaatcattcgcactgcatcgagacggaaagtgaatgagggccggggagcgtactcgcagtacgtgacccggtcgaatgagcgtagtcgtcgatgaggcagtgtgaaggatgaagtgtaaataaaaaaggaactattcttgcagtctcctcgttggtattcagttcggcgtcatttgctgctgatctcgaagacaatatggaaaccctcaacgacaatttaaaagtggtcgaaaaagccgataacgcggcgcaagtcaaagacgcgttaacgaagatgcgcgccgcagcgctggatgcgcaaaaagcaacgccgccgaagctcgaagataaatcaccggacagcccggaaatgaaagatttccgccacggtttcgacattctggtcggtcagattgacgacgcgctgaagctggcaaatgaaggtaaagtaaaagaagcgcaggctgctgcagagcaactgaaaacgacccgcaattcatatcacaagaagtatcgttaattcctcatttccctgttgcctgcactcaggtaacagggaacttatcatcgcaaatgatgcaccacctgattgctgctgccgcgccagatcagggaagggtcttttaaatcctgcacaaatttgccgtcgaccagcacgttaatcaaatcaacaacctgcatttgcgcagcgttgagttcgtcgagtttatagcctgtccacacccagatgtctttacccggacactcggcgcggatgcgttgtaccagtttcagaatatccggcacgttttgcggatgcagcggatcgccgccggagagggaaataccctggcgtttgatacgagtgtcattcagatcgttaatgatctggtcttccattgctttggtaaatggctgaccggaatttacccgccatgtgcttttgttatagcaaccggggcattcatgaacacacccggagacaaacagggtgcaacgagtgccggggccgttgacgatgtcgacaggatagtactgatgataattcattatttcgcctggcttatcagtccgcgtgtaggctgcatccggtaatcaatgcctgatgcgacgctgtcgcgtcttatcagacctggagcaattgccaaatgtaggccggataaggcgtttacgccgcatccggcatttgcttagctcagagtgaagattaacctatctgcccattccccaaatgtttaacgcggcgcttaacttcttcctgcttaccagcgttaaacggacgtgcatccgggctacctaaatatccgcacacgcggcgagttaccgacacacgggaggcgtcatggttaccacatttcgggcaagtgaagcctttgctggtgcactcgaactcaccggtaaagccacactcgtagcactcatcaatcggtgtattggtgccgtaatacggtacatgctgatagctgtaatcccagacatcttccagcgccttcaggttgtgctgaatgtttggatactcgccgtagcaaatgaaaccaccgttcgccagcggcgggtaaggcgcttcaaagtcgatcttgtcgtacgggttcaccttcttctccacatcgaggtggaaactgttggtgtagtaacctttatcggtcacgcccggcaccacgccaaactcagcagtatcgagacggcagaagcgatcgcacaggttttcactcggcgtgctgtagagactgaaaccataacccgtttcttctttccactgatccactgcctgacgcagacgttcaacaatggcgatacctttcgcgcgaagctgctcgttgtcgtaaacatgctcgccgccgaacagcgcgttaatggtttcgtggatgccgatgtaacccagcgaaatagacgcacgaccgtttttgaagatttcagaaacatcatcgtcagcattgagacgcacgccacaagcaccttccatatagaggatcggggccacgcgcgctttcacgccttcgagacgagcgatacgggtcatcagcgccttacgtgccagcaccagacgttcatccagcagcttccagaaggtggcttcatcgccttttgcttccagagcaatacgcggcaggttcaggctgatcacgccgaggttgttacgaccatcgtggatctgctcgccgttttcattttcccacacgccgaggaagctgcggcagcccatcggagttttaaacgaaccggtgactttcactacctgatcgtagttcaggatatccggatacatgcgcttgcttgcgcactccagcgccagctgtttgatgtcgtagttcggatcgccttttttatggttcaggccatcgcgaatcgcaaacaccagtttcgggaacaccgcagttttacggtttttaccgaggcctgcgatacggttacgcaggatcgattcctgaatcaggcgcgattcccagctggtgcccaggccaaaaccaaaggttacaaacggcgtctgaccgttggcggtgtgcagggtgtttacttcgtactccagtgactggaaggcatcgtagcactctttgatggttcgagagttagcgtagccttcggcgtccgggatgttccactcttctgcggtcttgcgatgtttgttgtagctggcagtgacaaacggtgccagcacttcatcgatacggttaatggtggtgccgccataaatatggctggcaacctgagcaataatctgcgcagttaccgcggttgccgtagagatcgacttcggcggttcaatctcggcgttccccattttaaagccctgggtcagcatgcctttcaggtcgatcaacatgcagttgaacatcgggaagaacggtgagtaatcgagatcgtgatagtgaatatcgccacgctcatgtgcctgcaccacgtcacgcggcagcaggtgctgacgtgcatagtgtttagccacgatcccggccagcaggtcgcgctgggttggaatcaccttgctgtctttgttggcgttttcgttgagtaacgaggcgttggtctgctcgaccagaccacggatctcctggttcaggcgaccgcgtttttcacgttcaatgtcgcgatcgtgacggtactcgatgtaagcacgagccagttgtttgtatggacctgacatcagctgattttcaactgcggtctggatctcattgatatccacctggttgcggccctgcatctgctcgctgacaaccgcggcaacagtggcgcaataatcggcatcatcgacttccgctgctttagctgcacgcagaatcgcttctttgatgcgctctgatttaaacggcactttgcagccgtctcgtttcatcacatgcggtgtcatgatcgctccatatttttaagaacaggttatccacagaaattgggaaaggcgttttccggttttttcgtttcgttttccggtgctttccgcaatcgccatccgcttatccacaacgccgcacctttttcgtggggagctgtagtagcaattatagtcgattaatacaacatattgggttgggacgcattttaaagtctatatatagtgctttgcatcaaggatgtttgagctttttttgatgtagctcaaagtaaaaagcagagcgtacggatgacgggcgctacagcgatatgtaaattttttaatgaatttgctggttgaaaaatcaacaaaaacaacatactgacagacaaaaccccggaatgaccggcattaccggggcttagggaagatttacttctgtaaccaccagacagcctcaaaaggccgtaaattcatggcacagggttgtggtgaggcttcttcgtagttatgcatcacaagctgccagttgccgcgcatttgccctgcctgccagggttggatctcacggctaaggttggcaatgaccagcaaggtttgccccttccattcacggcgatagcaccacaatacagggctgtttggcagcagatcctggtaattgccccatgtcaggatggcttcctgcttacgcagtgcgattaacttttggtaggtgtaaaacaccgaggaatcatcggccagcgcggcttctacgttgatttgttgatagttatcgcccaggccaatccacggttcgccagccgtaaacccggcattatcgccgttgctccattgcatgggcgtgcgactgttgtcacgggatttactggcgaggattgccaataactcgtcggcatcacgcccatcgttgcgcagctcggcaaacatattgaggctctctacgtcgcgatagtcagtaatgcgcgtgaaatgcgggttggtcatgccaatctcttcgccctggtagatatacggcgttccctgcatgccatgcagcaccatcgccagcatttttgccgcaggcacgcggtattcaccttcatcaccaaagcgagaaacaatgcgcggctgatcgtggttacaccagaacaaggcattccatgctacgttgtgcattccttgttgccagtggcggaacaatgttttcaacgccacaaagtcaggtttagccagcgtccatttttcaccaccgggataatcgaccttcaggtgatgaaaattaaaggtcatcgacaattcactgcctgtcagagccgcgtatcgctggcaatgctcaaggctggtggaggacatttcacctacggtcattaacccgcgtggcgtaaacacatcgcggttcatctcgtgcaaaaactcgtgtgctcgtggcccgtcggtgtagaagcgacgcccgtcgccgtccaggtcttcagggaaacgcgggtctttggagatcagattcaccacatccaggcgcaacccgtcgaccccacgatcggcccagaactcacagacttttttcagctctgcgcgtaccgctggattctcccagttgagatccgcctgttctggtgcaaagagatgcaaatagtactgttcgctttccgcatgccagcgccacgcactaccgccaaattttgaacgccagttgttcggtggcgtttctggttctccatcgcgccagatataaaactggcggtaagggctttctttgttcagcgcctcgcgaaaccaggcatgttgggtagaggtatggttaaacaccatatcgagaatgatacgaatcccgcgcgattttgcctgcgtcaccagttcgtcaaaatcgtccagcgtgccgtaggtgggatcaatcgccgtatagttcgctacgtcgtaaccgttatcgacctggggagagacataaaagggggttagccagatggcatcaacgcccagtttatgcagatagtccaggtgttggataacgccacgtaaatcgccggtaccgctacccgtggtgtcctgaaaactctttggataaatctggtagataacgccgttttgccaccagtggggaagatgagtcattacgttattcctgcgaatgcgagggggcgcaattgcgccccgaagaaaattaaacaatgtccagcgtgcccaggcggtatttccgctgatagataaacgaggtgagtacaatcgggatgatgatggcgatagccattgccagcgcaaacacctgccagtagctcggttgaatcgagagaattcccggcaggccgcctacgccgatgccattcgccataacgccgttcaggccgcatagcaatcctgccagaccagaaccaatcatcgcgcacagcatcgggaagcgatatttcaggttgatgccgtacattgcaggctcagtgaccccaagccaggcggagatagcggcaggcacggagatctcgcgttcattgtgcttgcggctggaaatgataatgcctatcacggcggagccctgagcgatattcgacagcgcaatcagcggccacactggcgtaccacccatgctttgaatcatctgcaaatcaatagcaagcgtggtctggtgtacaccggtgatcaccagcggggcgtacaggaagccaaacaatgctgcgccaatcggagcaaagctgccggtcatcaggtgacgtaccgcaaaggcaacgccatcgccaatcatgcgaccaaacggaccaatcagcgcatgggcgaggaacaccgcgaggatcagcgaacagacgggtaccaccaccagatagaggtaatccggcacgatgcgtttaaggcgagtttcaataacgcccagcgccagtccggctaacagtgccgggatcacctgcgcctgatagcctactttggcgatgctgaacatgccaaagtcccacacttccggcagctgctgcccgagcagataagcgttcatcagctgtggagaaaccagtgtcacgccaagcacgataccaaggatcggcgtgccgcccatttttttcaccgctgaccagcaaataccgaccggcaggtagaagaagatcgcttcaccgatcaaccacagaaaatcgtagatcgtttgcagggaagggtacatttgcgccagcgtctgaccgttgctcatgggcaaatcgccgatcacattgcgaaaaccgaggatcaaaccgccgctaatcaacgcgggcagcaacgggaagaagatcaccgcgaaatgagagatcaactgctcatgccatttcatattatgccgggcggctttttttacctgctctttatcaacctgcgcctgtccggttgacgcaatcagtgcttgatagtaatcacccacgttggtgccaatcaccacctgaaattgcccggcattggtgaaacagcctttcaccatagggagttgctcaatttctttcggtctggcattggccggttggttgaggacaaagcgtaggcgagtaatacagtggctcaccgtcgcaatattgccgcgcccgccgaccagttcaatcaaccgatcgatatccgtttggtttattttgctcatcataaagccccatggcagatgacatttttggttggctgcagaatatattgcgcggaaaaatttaaaaacgggaacgttcccgaaacgcagcgaagatcacaatttatcgttcaggaaacgatcaggacagggtggcggggatgatgatttgttgcggttcgctgcgcccggttacctgcgcgatcaactggcaagccgcctggcgtccagcttcggcgtaaccgggatctacggttacgatctccggatggaggaatttcattaacggcgtattaccgacgctcgccagttgcaaggtgtcgatgcgttgctcttgcaggtatttacttgcgccaagtgccagcgtgtcggttgcgcacagtaaggcggtagtttcaggcgtaatcacttttgcaacgttctcatagccttgcttcatagcaagccctggcagggcggcaacgggatgcagtttatgcgctttgcagaacgccaggtaggcttcgtgacgtcgcttaccggttgtcacgtcactgtgcggcacgccgagataactgatattacgatgcccctggtcatacagccgttgcatcaggattttgattgccccttcgtcgtcataacagaccgaagcaaagccttttgcgtcacgcgccagcagaaccagcgatgactgccagtgggctaacatttcttctgttatgccagtaaaaccgaacagcactacgccgtcgatattacgccgtttcagcactcccaaatgttcggcaactaattgcggggaaaactgactttccatcatgattgggtcgtaaccttgttcatagaacgctggcagcatggtttgaacggcgagattttctgacaacgaatccagacgggtaacaatgatggcgaccactttatcgctttgcccacgcatagcgcgcgcagagcgggaaggggaaaatccatgctgattcatcactgcttcaacacgctcgcgggtgagctggctcacgccgctttcgttattcagcacccgggaaactgtagatttccccacgccgcttaagcgcgcgatatctttgatggtcagccgattttgcatcctgttgtcctgtaacgtgttgtttaattatttgagcctaacgttacccgtgcattcagcaatgggtaaagtctggtttatcgttggtttagttgtcagcaggtattatatcgccatagatgctacgaatattattggattctccttattatttgcggcgcttttttcacttaccggaggttatatggaacctgatcccacgcctctccctcgacggagattaaaacttttccggtaagcccgtcttttcacggcgttaccggatgcgtaaggccgtgacgttttaacgtccctgctcagctttattaccttcaggtaaggcttcgccacgcctgaagacatttctgtactgtttcagacagtgcggagggactccttatgtttaaagaaatttttacccggctcattcgccatttaccttcccgtctggttcatcgtgatccattgcctggcgcgcagcagacagtgaatacggtggtcccgccgtccttaagtgcgcattgcctgaaaatggcggtgatgcccgaagaagaattgtggaaaacgttcgacacccatccggaagggttaaatcaggcggaagtggaatctgcccgcgaacaacatggtgaaaataaattacccgcacaacaaccgtcgccgtggtgggtacatttatgggtctgctatcgcaacccctttaatattttactcaccattctcggcgctatttcttacgccacggaagatttatttgctgcgggcgttatcgcgctaatggtcgctatttctacgttgctgaactttattcaggaagcacgttccactaaagcggcagatgccctgaaagcgatggtcagcaatactgcgacggtgctgcgcgtaattaacgacaaaggcgaaaatggctggctggagatcccgatcgaccagctggtgcccggcgatattataaaactggcggcgggagatatgatcccggcagatttacgtatcttgcaggcgcgggatctgttcgtcgctcaggcgtcgttaaccggtgagtctctgcccgtagaaaaagccgctaccactcgccagccggagcacagcaatccgctggagtgcgacacgctgtgttttatgggcaccaccgtggtgagcggcacggcacaagcaatggtgattgctacaggtgccaatacctggtttggtcaactggcggggcgtgttagtgagcaggaaagcgagccgaatgcctttcagcaagggatcagccgcgtcagtatgctgctgattcgctttatgctggtgatggcaccggtggtgctgttaatcaatggttacaccaaaggcgactggtgggaagcggcgctgtttgcgctttcggtcgcggtaggcctaacgccggaaatgttgccgatgattgttacctcgacgctggcgcgcggcgcagtaaagctgtcgaaacagaaagtgatcgtcaaacatctggatgctattcagaactttggcgcaatggatattctgtgcactgataaaaccggcaccctgacgcaggataaaattgtgctggagaatcataccgatatctccggtaaaaccagcgaacgcgtgctgcatagcgcgtggttgaacagtcattatcagaccggacttaaaaacctgctcgatacagcggtgctcgaaggtacggatgaagagtcagcgcgctcgctggccagtcgttggcaaaaaattgatgagattccgtttgatttcgagcgtcgccggatgtcggtggtagtggcagaaaataccgagcaccatcagctggtttgcaaaggtgcattgcaggaaatcctcaatgtgtgttcgcaggtgcgtcacaatggcgagattgtgccgctcgatgacatcatgctgcgtaagattaagcgggttactgatacgctgaatcgtcaggggctgcgcgtggttgcggtggcgacgaaatacctgccagcgcgtgaaggagattaccagcgggcggatgaatccgacctgatcctcgaaggatatattgcttttcttgatccgccaaaagagacaaccgctccggcactgaaggcattaaaagcgagtggaattaccgtaaaaatccttactggcgacagtgagttagttgcagcgaaagtgtgccatgaagtggggctggacgcgggagaggtggtcattggtagtgatattgaaacgctatctgacgacgaactggcaaatcttgcacagcgtaccacgctgtttgcccgcctgacgccgatgcataaagaacgcattgtgaccttactgaagcgcgaagggcatgtggttggctttatgggcgatggtattaatgatgcgcccgccttacgcgctgcggatatcggcatttctgtggacggcgcggtagatattgcccgtgaagcggctgatatcatcctgctggaaaaaagcctgatggtgctggaagagggggttattgagggacgtcgcactttcgccaacatgctgaaatacatcaaaatgacggcgagctctaacttcggtaatgtgttcagcgtgctggtagcgagtgctttcttgcccttcctgccgatgttgccgttacacttgcttattcagaacctgctgtacgatgtgtcacaggtggcgatcccgtttgataacgtcgacgacgagcaaattcaaaagccgcagcgttggaatccggcggatctggggcgctttatgatcttcttcggaccgatcagctcgatcttcgatattttgacgttttgcctgatgtggtgggtattccatgccaacacgccggaaacgcaaacgctgttccagtcgggatggtttgtggtgggcttactgtcgcaaacgctgattgtgcatatgatccgcacccgccgtgtgccgtttattcagagctgtgcatcgtggccgttaatgatcatgaccgtgatcgtgatgattgtcgggatcgcattgccgttttcaccgctggccagttatctgcaattacaggcgctgccgttaagctatttcccgtggctggttgcgattctggcagggtatatgacattaacccagttggtgaaagggttctatagccgtcgttacggctggcaataaagaataaactgggcacgatagccccgattcagattgtagacaaagtgagttttgttcatgccggatgcggcgtaaatgccttatccggccaacaaattcaataaattgcaggaatcacgtaggcctgataagcgtagcgcatcaggcgattttgcgtttgtcatcagacttaatccgggcatgatagcccggatttccatcaagattagcgacgaacagcgatcgcttcgatctcaatcttcacgtctttcggcagacgggcaacttcaacgcaagaacgtgccgggaaggtggcgttgtgttcggtgaagaaggcttcgtaagtggcgtttacggttgcgaagtcgttcagatcttttacaaacacggtagttttaacgatgtcgcccactttcaggccagcggcttcgacgatcgcttttacgttatccagcgactgacgtgcctgtgcagcgacgtctgccggtacttcgcccgttttcggatttaccgggatctgaccggaggtgatgatcatattgcccagatcaacgccctgtacgtaaggaccgatagctgccggtgcattttccgtcgcgatagttttgctcatgatttctcctttattacagcggtaaaaagtctggctcattatagggagccagacttttattaccaaccgcaattaattggccagcaccacattatgggaaaactctttttcacagtatttgcatttgagcgcgatatcattggcgcgttttcgcacggcaaagctggatgaaaccggttcggcatggctgatacagttgctgttcgggcagaccagcacattgtcgatgcgctccggcagacttgggcgcgatttacccaccacttcatagttgtcgatacggttaaccgtggcttgcggcgcatacaatgccagttgatctacttgatcttcactcaaaaaggtattttcgattttgatcagatctttgcggcccatctcgccagaaggcaggttcagaccaatggtgatgcgctgatccgtttcggtcagcttgaacagactcaacagcttaaaaccgatctgggcggggatatggtcaattaccgtgccgcgtttaatagcttcaacctgcaatttattatcgtgtgtcatctctatttccccttacagtaccagatcgcgattcagaaccagtgccagtaacgcctggcgagcgaaaatcccgttgcctgcctgctggaagtaccaggcgtgtggcgttttatcaacatccgtcgcaatctcatcaacacgcggcagcggatgcagcactttcatattggctttggcgttgtggagatcgctggcgcgaagaacaaactgcgctttcacgttggcgtactcggacgggtccagacgctctttttgcacgcgggtcatgtacaggatgtctacttccgccatcacttcttcaatagagctgtgcagactccatgcgatccctttttcatcgagcatatccagaatgtattgcggcattgccagcgcgtccggcgcgatgaagtaaaaacggttgccgtcgaacttcgctaacgcctgagtcagggagtgaacggtgcggccatatttcaggtcaccaaccattgcgacgtggagattgtccagacgcccctgggtttcctgaatagtgaataagtccagcaaggtttgcgtcggatgttggttggagccatcaccggcattcagtaccggtacattgccggaaaactcggtggccaggcgcgccgcaccttcctgcggatgacgcatcactatcgcatcgacgtaagtgctgataaccgaaatggtatcggccagcgtttcgccctttttacccagtgatgtattggcgctgtcggagaagcccaccacgctggcccccaggcggtgcatagatgtttcgaaagagaggcgggtacgggtagaggcttcgaagaaacagctggcaatgactttgtgcttcaacagctctggttgcgggtttgctttcagtttcgccgctgtcgccagcaccagattaaggtcatcgcgactaaggtcgtttatggaaatgatatgtttctgatatagcggattagccatcttttatctcctgacgcctgggcaaaaaaaagcccctcgattgaggggctgggaatgggtgatcaacgggaagaaaaacggcaggccagcgtcttttttcagacgcggtaagacaaaatgtcgaacacactgaaccatacatcctcccggcaaattgtccggcattatactcatcgtcagaagcggcgcaagcatttgatgcaatattttgtcagcgcaaacggtttatttgaattaaaagtcaaggtatatgcatttttatttgatgtgattctgcaggggaactgtccttcggtatcaataattgcagacattccctgctttttcctttttcactttcacgcaatcagatatgcattttattccattcatccgacttatagggcggagtgtgaaagcgaacggctaacactattgcttactgctcagggatgcgcgctatcactttaatttcaaaatcaaagcctgccagccatgtaacacccaccgccgtccagtttggataaggtggggcgctaaatatttcatttttcaccgtcatgatgtcttcaaattggttttctggatcggtatggaagctcgtaacatcaatgatatcgtcaaaagtgcatcccgcagctgccagggtcgcatgcaaattatcaaatgccagtctgacttgttgctgaaaatcgggttctggtgttccgtcctctcgacttcctacttgcccggaaacaaacagcaaatcgccggaacgaatagccgcagaataacgatgctcagcatatagtgaatgtcggccagcagggaaaacagcggttctttctaccatttggttatcctcaagatttacgacatgaacagaagatttctctttaccgggagccgcttttagcggacgacgtgagtaaacaaaacccagacatcatggataatggctgggcttaattgagcgtagtcggttatgcgccaaacgcgccatcaatggtatgcatcgcgccggtaacaaaactggcttctggccctgctaaccatgcgaccataccagcgacctcttccggttgcccatgtcttttgatagccatcaaactatgcaacatatcgcgcattggcccgttggcgggattagcgtcggtatcaattggccctggctggacgacgttaatggtgatcccacgcggtccaaaatcacgggccagcccgcgcgccatgccttgcagggcagatttgctggcggcataagcagccatgcctgcaacaggcatacgatcgccattcacggagccgatgattaagatgcgcccgccttcgggcatctgccgggcggcttcaacagaggcatgataaggagcatgaatattgattttgaaaaggcgatcaatatcgtcggcatttaattccagggcctcgccaaagacgccaatacctgcatttaccaccaggatatccaatgcgccgctcttacgaacgacatcaatgacagcgtctctgtcagcactatctgtgaatactgctgtcgctccagtctcttgtgccaggcgtttagcggcatctttcgaccccgcataggtgaatcgtacattggccccatcggtgacgaaacgacgtacgatagcggcaccgataccacgactgccaccgaggatgagaactgtcttacctgtaaaagcgcccataaggactccttgatttattatgtaacatgcattacaaaactgttttaactttctgtcaacaggttttgtaatggtcactaaaaaacaatctcgcgttccaggtcgtcccagacgtttcgctcctgagcaggcaatctctgcggcaaaagtgctttttcaccaaaaaggtttcgatgctgtcagtgttgctgaagttactgattatcttggtattaaccccccgagcctctacgcggcttttggcagtaaagctgggttatttagccgtgtactcaatgaatacgtcggtacggaagctattccgcttgccgatattcttcgtgatgatcgtccggtaggcgagtgcctggttgaggtattaaaagaagcggcgcgcagatatagccaaaacggcggctgcgctggctgtatggttcttgaaggtattcatagtcatgatccacaagcgcgtgatattgccgttcaatattatcacgccgcagaaacgaccatttatgactacatcgccaggcggcatccacaacgcgcacaatgtgtgactgattttatgagtaccgtgatgtctgggctttctgcgaaggcacgagaggggcactctatagaacaactctgtgcaacagctgcaatggcgggggaagcgataaaaactattcttgaggagtgatgcgggccttgacccgaaaggcgggaaagcgcctgccgataagttgtgataagacaataattcacgcgttaaggctagcggaattgattatcttttcgtataacgatagaaatgaaacgttgttttaattaaggagtggaaaagatgatcatcggaaatattcataatcttcagccgtggctaccccaggagttacgccaggcgattgagcatatcaaagcacacgttacggcagaaacgccaaagggcaagcacgatatcgaaggcaatcgactgttttatcttatctcggaagatatgaccgagccgtacgaagctcgccgtgcggagtaccatgcccgctatcttgacattcagattgtgttaaaaggtcaggaaggcatgaccttcagcacgcaacctgcaggcgcgccggataccgactggttagctgataaagacatcgcatttttgccggaaggcgttgatgagaaaacagttattctaaatgaaggtgattttgttgtgttttatccgggggaagtgcataaaccgctgtgcgcagtgggcgcgccagcccaggttcgcaaagcagtagtgaagatgctgatggcgtgatgacttttcgccgtaaataactcaaggtttacggcgagtttgtgaaaagagcgttttttgatatttttttgtgagtaaaatttgtaatgcttagacgttcttattcactcaaggagttcgtcatgagcaaaatatcagatttaaattattctcaacacattacattagccgacaattttaaacaaaaaagtgaagttttaaatacctggcgtgttggaatgaatgattttgcccgtattgccggggggcaggataacagaaggaatattctttctcctggagcatttttagagtttttggcaaagatatttaccctgggttatgtggattttagcaaacgctccaacgaagcgggtagaaatatgatggctcatattaagtcctcatcttattctaaagatactaatggcaatgaaaaaatgaagttttacatgaataatcctgtaggggaacgagcggattcacccaaggtgattatagaaatttcactttccactatcactactatggggactcgtcaaggacatacagccattatatttccacaacctgatggttcgactaaccgttatgaagggaagtcctttgaaagaaaagatgagagttcattacacctgattactaacaaggttctggcgtgttaccaaagtgaagctaacaagaaaatagcgcgtctattaaataataatcaggagttaaataatctacagaaattaaataatctacagaagttaaataatctactgaagttaaataatatacaggggttaaataatcctcaggagttaaataatccgcagaatttaaatgattctcaggagttaaataactcgcaggaattaaatagtccacaggagttaaatgatccgcaggagttaaataattctcaggacttaaataactctaaggtgagttgtacagtttcagttgattctacgattacgggtttattaaaagaaccattgaataatgcattattagcaataaggaacgaacatctgctattaatgcctcatgtatgtgatgaatcgatttcatacttactgggcgaaaaaggtatacttgaagaaatagataagctctacgcattaaatgatcacggaattgataatgacaaagtaggtaacaatgaaattaatgacatcaaagttaacctgtctcatattcttattgattccttagatgatgcaaaggttaaccttacaccggtcatcgattcgattctggagactttttcaaaatccccatatattaatgatgtaagaatactggattggtgttttaataaaagcatgcaatattttgatgatactaaaaagataaagcatgcatgctccgtaataaatcatattaatcttcgcagcgatcagtctaaaatagctgagacattatttttcaatctcgataaagaaccctataaaaatagccctgaattacaggggttgatttggaataagttggttgtatatgtcaatgaatttaacttaagtaatcgagaaaaaacaaatttaatacaaaggctatttgataatgttgagtctatatttaatgaagtacctgtcagcattttagtgaatgatatttttatgaatgatttctttatgaaaaatcctgagatgattaattggtacttccctcagttacttaagagttatgagggtgaaaagatttattttgataatttaaaatatgatttaaatgataatgataaggaatctaataaagaaattttgaagaatcaaccagataatgttatcaaagaaaaactgaataatgaatacaaacttagatttagaatgatgcaaactatcttgcaatcgagagttaatgtattaccatatattaatgaacagcgtttaaataaactaaatccaccggaaaatttacgtatagcaatagaacactttgggtggaagaatagacctatcactgcataaaataatgtgatgccgggatggtttgtatttcccggcatctttatagcgatagcaattatttactgagcgtcgcgaccatcaccgctttgatagtatgcatacggttttccgcctgatcaaaaacaatgctggcggcagattcgaagacctcatcagtgacttccataccgccatgtaggccaaattcttccgccattttcttgccaagcgtcgtttggtcgtcatgaaacgcgggcaggcagtggaggaatttgacctccgggttaccggtcaactgcatcatcttgctgttcacctgatattcacgcagcaatgcaatccgttccgcccatttctcttttgcttcccccatcgacacccacacatcggtatagataaagtcagcaccttcaactcccttcgcgacatcttcagtcagcgtaatattcccaccattttgctgtgccagggcgcggcattccgtaaccagcgcagcttccggccagcacgcttgtggcgcgaccagacgcaaatccagaccggtaagcgccgcagcttcgagcatcgaattgcccatgttgttacgcgcgtcacctgcatagaccagcgtcatttcgttgaacgctttgccgggcaaatgctcctgcatggtgagaagatccgccagcagctgcgtgggatggaactcattggtcaggccattccataccggcacgctagcgtattccgccagtgtttcgacaatctcctgaccatagccgcgatactgaataccgtcatacatgcgaccaagcacgcgggcagtgtctttaatcgactctttatgaccaatctggctgccgcttgggccgagataagtaacgcgagcaccctggtcatatgcggcaacttcgaaagagcatcgggtacgagtcgagtctttttcgaagatgagcgcgatgtttttaccagtgagtttggcttcttctttaccgcttttcttatcggctttcagcttcgcggctaactgcagcaggctgttgagttcagctggcgtgaaatcgagtaatttcaggaaatgcttatgataaaacccggacatagatccctcctgtggctaacgcctcaatgaattaaaattcaatttatatggatgattattcatttgcaagtctaaagcataaatctttgtcacaaaggtggaggcaatgtcagtggtgtgtgacaataagagtatcggcaggacattaagaggaatgagccatggcaaacccggaacaactggaagaacagcgtgaagaaacacgtttgattattgaagaattactggaagatggcagcgatccggacgcgctgtacaccatcgaacaccatctttccgcagacgatctggaaaccctggaaaaagcagcagttgaagcgtttaaactcggttacgaagtgaccgatccagaagagctggaagttgaagatggtgatatcgtgatttgctgcgacatcctcagcgagtgcgcgttgaatgccgatctgatcgatgcccaggttgaacaactgatgacgctggcagagaaatttgacgttgagtacgacggatggggcacttactttgaagatcctaacggcgaagatggcgacgatgaagattttgtcgatgaagacgatgacggagttcgccactaattaagcgtagcgcatcaggcccaggtagttcctgcaacctggtgaatttgtagcccggataaggcattcatgtcacatccggcataaacaaaacgtacgttgttaatgttcgaatgcccgcgagttgaacacgcgggcatttttttagagttcgcgcaacatccgcacttcacaatcgacatggcccgtgcagccaagcgcatagtcgatatgctcaaagcccaaatgctcataaagcgcaatggcttcctttaaaaaagcggtcgtttccagatagcagcgtttgaaacccatctctcgcgcctgctccatcgccattaaggccagtttttttgccagccctttgccgcggatagccggaagaaaatacatcttttgcagttcgcaaatatccgactcactcccggttaatggcgctatcccaccgccgccgaccacttcaccctcgtactcaacgacccaatatgcatggccaggctgactatatacttgatacagctcgtcaagattcggatcggcgacggtgtagcctttatcagcggtaagaccgtattcggcggatacctgacgaatgacgcgggcgatagcaggattatcctgcagcgtcaggcgacgcattacaggtgattgcggcgcaatgttattcatagtttaacccaataaaaataaagtaattatacatttgtttaataccactctcttcttacgtacgcaagcgacttataaagtaataaagtttttgccagcctattactgataagagtattgtaacgtggcagaacattttactgtctgtatatataagttatatcaatggattttttaattcagggaatttttatggctcaagttattaatgaaatggatgttccgtcccattcgtttgtttttcatggtacaggtgagagatattttcttatttgtgtggtgaatgtgttgttaacgattataacgctaggtatctatttaccatgggcattaatgaaatgtaagcgttatctttatgctaatatggaagttaacggacaacgattttcttatggaattaccggtgggaatgtttttgttagttgtcttttttttgtttttttctatttcgcaatcttaatgacagtgtcagcagatatgccgcttgttggttgtgttttgactttgttactgttggttttgcttatatttatggcagcaaaaggactgcgtcatcaggccttaatgaccagtctcaacggcgtaagatttagttttaattgctctatgaaagggttctggtgggtgacctttttcttgccgattttaatggccattgggatggggactgttttctttatctcgacaaagatgctacctgccaatagttcaagtagtgttattatatccatggttctgatggcaatagttggtattgtttccattggtatttttaatggtactttatatagtctggtaatgagttttctctggagtaataccagtttcggtatacatcgtttcaaggtgaaattagatactacgtattgtataaaatatgccattctcgcatttttagctttattgccttttctcgctgttgctggttatattatcttcgatcaaatattaaatgcgtatgatagttctgtatatgcaaatgatgacattgagaatttacagcaatttatggaaatgcaacgtaaaatgataatcgcgcagttaatctattattttgggattgctgttagcacaagttatttaacggtgtctttgcgaaaccattttatgagcaacctgtcactgaatgatgggcgtattcgttttcgcttaactttaacgtaccacggtatgctttatcgcatgtgtgcgttggtggtgatatccgggattacgggcggtctggcttatccactgctgaaaatatggatgattgactggcaggcaaaaaatacgtatttgctgggcgatttggatgaccttcctttaatcaataaagaagaacaaccagataaaggcttcttagccagtatttcacggggagttatgccttctttaccatttctgtaagagataaaaaaggccggagcatgctccggccttcgttttcatcactgtgttttgattacagcgcggcgataacagcctgctgttcaatcagtttcgctttcgcttccgcatagccttccagcttctcacgctctttcgcgatgaccgcttccggtgcgcgggcgacaaagccttcgttcgccagtttgttctcgatacggctgatttcaccttcaatcttcgccacttctttcgccagacgcgccagctcatcttctttgttgatgaggccagccatcgggatcagcagctctgcaccgtcgatgatcttcgtaacggaaaccggacctttgtcatcggcaggcagcacggtgatactttccagacgcgccagggtttgcaggaagccacggttttcatttacgcgacgttctgcatccgcgctgcaaccacgcagcagcagctccagcggtttgcccggcgcgatgttcatttctgcacggatgttacgtaccgcaacgatcgcctgtttcagccattcggtgtcggccagtgcggcttcatcaacctgagatgcatcgtactgcgggaacggctgcagcatgatggtgtcggcagtgataccgcaaagtactttcacacgctgccagatggtttcggtgatgaacggaatgatcggatgcgcgaggcgcagcagaccttccagtacagtcaccagcgtatggcgagtaccgcgcagttctgcttcggtgccaccgttcattaccggcttggtcagctcgagataccagtcacagaactggttccaggtgaactcatacagaatgcctgcggcgatatcgaagcggaagctgtccagcgcttcgcggtacgctttgatggtctggttgaactccgccagaatccagcggtccgccagcgacagcgtcatttcgccgccgttgaagccgcaatcctgaccttctgtgttcatcagcacaaagcggctggcgttccacagcttgttacagaagttacggtaaccttccagacgcttcatatcccagttgatgtcacgaccggtagacgccagcgccgccagggtgaagcgcagcgcgtcagtaccgtgcggctcaataccgttcgggaactgcttctcggtgcgcttacggattttgtccgccagctgcggctgcatcatattgccggtacgtttttccagcagttctggcagcgaaataccgtcaaccatatccagtgggtcgataacgttacccttggatttggacatcttctggccttcgtcatcacgaatcaggccggtcatgtaaacggtgtggaacggcacctgcggtttgccattttcatctttgatgaagtgcatggtcatcatgatcatgcgggcaatccagaagaaaatgatgtcgaaaccagataccatcacgctggttgggtggaactgacgcagggcgtcggtattttccggccagccaagggtagagaaggtccacagcgcagaagagaaccaggtatcgagaacgtcttcgtcctgacgcaggacaacatcagcaccgaggttattttctttacgcacttcgtcttcgttgcggccaacataaacgttacccgcttcgtcataccatgccgggatacggtgaccccaccacaactgacgagagatacaccagtcctgaatatcgcgcatccaggagaagtacatgttttcgtactgcttcggtacgaactgaatgtcgccgttctcaaccgcttcaaccgccggtttcgccaggacatcggcacgcacgtaccactggtcggtcagcattggttcgataactacgccgccacggtcgccgtaaggaacggtcaggtcgtgcggtttaatttcttccagcaggccaagcgcgtcaactgcggcaacgactgctttacgtgcagcaaaacgctccagtttctggaactctgcagggatttcgctggaataaacgtcagattcgttacctttggtatcgaacacctgggcgctttcacggatatcgccgtcaaaggtcaggatgttgatcatcggcagggcgtgacgtttacccacttcatagtcgttaaagtcgtgcgccggagtgattttcacgcagccggtgcctttttccatgtcggcgtgttcgtcgccaacgatcggaatacgacggttaaccagcggcagaatgacatatttgccaatcagatctttgtaacgcggatcttccgggttaacggctacgccagtatcgcccagcagggtttctggacgggtagtcgcgaccaccagataatctttaccgtctgcggttttcgcaccgtcagccagcggatagcggatgtgccacatcgaacctttcgattcgcggttttcgacttccaggtcagagatagcggtgcgcagtttcggatcccagtttaccaggcgtttgccacggtaaatcaggtcttctttatacagacgaacgaaaacttctttcaccgcattggacaggccttcgtccatggtgaagcgttcacgctcccagtcgacggagttgccgagacggcgcatctgacgggtaatggtgccgccagattccgctttccattcccagattttgtcgatgaaagcttcgcggccgtagtcgtgacgggttttaccttcttctgcggcaatcttgcgctcaacgaccatctgggtagcgatcccggcgtggtcagtaccgacctgccacagggtgtttttgccctgcatgcgctgatagcggatcatggtatccatgatggtttgctggaaggcgtgacccatatgcaaactgccggtgacgttcggcggcgggatcatgatgcagaaactttcctggctttcatcgccattaggcttaaagtagccctgcttttcccagtgctcgtaaagcggctgttcgatatcttgtgggttatatgtcttttccattatttccaggttgccgtattcaggttgaaaccagccacgcggtaggctttatagcgttcgcgcgccagttgtttcagagaatcttcataaggaacgaagtctaccacttctgtgaaagcggtggcaaaatctgcaaagcttgttcgcagactaatcaatatatcgcgccggctgctgctacgcttttgcggccaggcgatctccaccggtgcaccgccgcgcggtccttctcccgctaaattatgcggaacaaagctttctgccggacgcgcccacagggcttcatccagccggtaagcctgcttttcatcttcacaggcgatgagcacgcgcttaccgctgcgccaacgttctgcggcaatttcacacaccagttgctcaacggcgcttaagccatcgacggtggtgtcattgtccagaaggtagaacgtcgcgtttttcataaatggggcttcttgtggtggatttaaatacgcatcaggtatacaccgcagcgcctgatgcgacgctgttgtgtcttatcaggcctacgagttcagtgctgtgtaggtcggataaggcgttcacgccgcatccggcaataacagccttgcctgacgcaattactcttcgccgttaaacccagcgcggtttaacaggaactgtgccagcaacgctaccggacgaccggtggcgccttttgctttaccagaacgccaggcggtaccggcgatatccaggtgcgcccagttgtacttacgggtaaagcgtgacaggaagcaacctgcggtaatcgccccaccaggacgaccgccaatgttcgccatatcggcaaaattggactccagttgttcctgatactcgtcacccagcggtaagcgccatgcgcggtcaccggattgttcagacgcggcaatcagttcatgggccagcggattatggttcgccatcagaccagtaatatgatgacccagcgcgatcacgcaggcaccggtcagcgtcgccacgtcaatcaccgcttccggctcaaaacgctcaacgtaagttaacacgtcgcacagtaccaggcggccttcagcgtcggtgttcagcacttcaacggtttgaccggacatggtggttaacacatcgcccggacgataggctcgtccgccaggcatgttttcgcagcctgccaacacgccgataacgttaatcggcagttgtagctccgcgaccatccgcatcacgccgtaaaccgctgccgcaccgcacatatcgtacttcatctcatccatgccttctgaaggcttgatcgagataccgccggagtcgaaggttaaacctttacccaccagcacgattgggcgtgcatcttccgacgcgttgcctttgtactcaatcaccgacatcagcgattcgttttgcgaaccctgaccgaccgccagataggaatgcatccccagctctttcatctgctgttcgccgataacgcgggtgatgacattcttgctgtagctgtcagccagctggcgcgcttgtgaagcgaggtaagcggcgttacagatattcggcggcatattgccgagatcttttgctgctttaatcccggcggcaatcgccagaccgtgctggatcgcgcgctcaccgctggtcagttcacggcgggtcggcacgttgaacaccatcttacgcagcggacgacgcggttcgctcttgttcgttttcagctgatcgaaactgtagagcgtctcttttgccgtctcgacagcctgacgcactttccagtagttgttacggcctttaacgtgcagctcagtcagaaagcagaccgcttccattgagccagtatcattcagcgtattaatggttttctgaataacctgcttgtactgacgctcatccagctcacgttctttgccgcaaccaataaggagaattcgctcggaaagtacattcggaacatggtgcagcaacaatgtctgccccggttttccttccagttcgccccgacgtagcagggcgctgatgtacccatcgctgattttatcgagctgttctgcaatcggagaaaggcgacgtggttcgaagacgcccacgacgatgcaggcactccgctgtttctccgggctaccgctttttacactaaactccatgcactacgctcctgaatcttaaagacaacggcggtggctacagatagaattgcaagctttcgtaactcatgtccgctgttgcgatgacttcgtgttaatcttaacgttattacggcattggcacgtcagaacaaaatctgagaggtgaatccgttgagtataattatcttagcgacgatttcgacgactcaagagaataaatgacgtttaagccatgaaacaagctaaaatcctgcaaaagacgagtttttacgggcgtatttaaagtgataatcataagatatctggtgcgggagacgctcaaaagccagctggcgatactcttcatcttgcttttgatcttcttctgtcaaaagttagtgaggatcctcggcgcagcggttgacggcgatattccggcgaatctggtgctctcccttctcgggttgggcgtgccggaaatggcgcagcttatcctgccattaagcctgttcctcgggctgctgatgacgctgggcaaactgtataccgaaagtgaaattacggtaatgcatgcctgcggcctgagcaaagcggttctggtgaaagcggcaatgatccttgcggtattcacggcaatcgtagcggcggttaacgtgatgtgggcgggaccgtggtcatcgcgtcatcaggatgaagtgttagcagaagcgaaagcgaaccctggcatggcggcgctggcgcaagggcaattccagcaagcgactaatggcagctcggtgctgttcatcgaaagcgttgacggcagcgatttcaaagatgtgttcctcgcgcaaattcgaccaaaaggtaatgcacgtccttctgtggtggtggccgattccggacatttaacccagctgcgcgacggctcccaggtcgtcactctcaaccagggaacgcgcttcgaaggcactgcattgttacgtgatttccgcattacggacttccaggattatcaggcgatcattggtcaccaggcggtggcgctcgacccgaacgataccgaccagatggacatgcgcacattgtggaacactgacaccgatcgtgctcgcgcagaactgaactggcgtatcacgttggtattcaccgtgtttatgatggcacttatggtcgtaccgctgagcgtggttaacccacgtcagggacgcgtactgtcgatgctgccagccatgctgctgtatctacttttcttcctgatccagacctccctgaaatcgaacggcggtaaaggtaagctggacccgacgctgtggatgtggaccgttaacctgatttatctggctttagcgattgttctcaacctttgggacaccgtgccggtccgccgcctgcgcgccagtttttcgcgtaaaggagcggtgtgatgcaaccttttggcgtacttgaccgctatatcggtaaaactattttcaccaccatcatgatgacactgttcatgctggtgtcgctgtcgggcattatcaagtttgtcgatcagctgaaaaaagccgggcaggggagttacgacgcgttaggcgcaggaatgtataccttgctgagcgtgccgaaagatgtgcagatcttcttcccgatggcggctctgcttggggcgttgcttggtcttgggatgctggcgcagcgcagcgaactggtggtgatgcaggcttctggttttacccgtatgcaggtggcgctgtcggtgatgaaaaccgccattccgctggtcttgctgacgatggcgattggcgaatgggtcgcgccgcagggcgagcagatggcgcgtaactaccgtgcgcaggcgatgtacggcggctcgttgctctctacccagcaaggcttatgggcgaaagatggcaacaacttcgtctacattgagcgggttaaaggtgacgaagagttaggtggcatcagcatttatgcctttaacgagaatcgtcgtctgcaatccgtacgctatgccgctactgcgaagtttgacccggaacataaagtctggcgtctgtcgcaggttgatgaatctgatctgaccaatccgaaacagattaccggttcgcagacggtgagcggcacctggaaaaccaacctcacgccggacaaactgggcgtggtggcgctggacccggatgcactctctatcagcggtttgcacaactatgtgaagtatctgaagtcgagcggtcaggatgccggacgttatcagctcaacatgtggagcaaaatcttccagccgctatctgtggcggtgatgatgctgatggcgctgtcgttcatctttggcccactgcgtagcgtaccgatgggcgtgcgtgtggtcaccggtatcagtttcggttttgtcttctacgtactggaccagatcttcggcccgctgacgttggtttatggcatcccgccgatcatcggcgcactgttgccaagcgccagcttcttcttaatcagcctgtggctgttaatgagaaaatcgtaaccgaatgaacgaataaagggagcgaaagctccctttattattgttagcaaagtgtgcttcgttcattcctgaaaaataattaaaattcaatatattgcagtggggtgggcatgataagacgcgccagcgtcgcatcaggcaaagacaaatctcgcctgacttaccttcttctcccccccagcaaactccccaacatcccgcgtacaatctgattcgtcacttggcgagcggcgcttttggccattgtttgcaccacaccatctttcttcccgccgcgtggtccggtagtgccgaacaaaatatccttcaatccaccaagaatgccgtcatccaccgctacctctttccctttcgcgggaggattattttgctgctcggtactggcctgaaagcctttttgcaacatctcataggcggattcccggtccacctcatcctcatatttgccatacaccggagagtgattaatcaagccattacgctcatcttccgtcaccggccccatccgcgaacaaggcgcgatcaccatcgcacgctccaccacagaagggcttcctttcgcatccagaaaagagatcaacgcctcgccggtgcccagttcctgaatcgccttttcggtatcaaacgccggattggcccgcatggtttgcgccgctgccttcactgctttctgatcttttggcgtaaaagcccgcaaagcatgttgaacgcgattaccgagctgcccgagcacattatccggaatatcagacgggttttgcgaaacgaaccagacgcccacgccttttgagcgaataagccttatcacctgctcaatcttatccagcagtacctgcggggcatcgttaaacagcagatgtgcctcgtcgaagaaaaacaccagttttggtttctccagatcgcccgcttccggcaattgttcatacaactctgaaagcatccacagcaggctggcggcgtacagtttcggcatctgataaagtttctcggcgctgaggatattgataacgcctttaccgttggcatcggtgcgcatccagtctttgatatccagcatcggctcaccaaagaagtgtgctgcgccttgctgttccagcgacaacagcccgcgctggatggcaccaaccgatgcgctactgatattaccgtactgattctggaaggatttggcgttatcgccgatgtactgggtaattgcccgcagatctttaaagtcgagcagtaacagcccctgatcgtcagcaatgcggaagatgatattcagcacgccagattgcacatcgttgagattcaacagtcgtgccagcaacagcggccccagatccgaaaccgtcgcccgcaccggatggcctttctcgccaaagatatcccacaccaccaccggattggcatgcggttgccagtcattgacgccgatatttttaagccttgcgagcagtttttccgacaccgttcctgcctgcgcgacgccggtcagatcgcctttcacatcagccataaacaccggcacgccgatttccgacaatgactccgccagtttttgcagcgtaacggttttacccgtccccgttgcgccggtaatcagcccatgacggttagccattcccggcagtaaaaacagttctgtgtccggcgtgcgggcaattaacaggggttcactcatgagatatcctccagtttcctgcctggagtataggcaacgtccggcaaagagaatacgtgtaatgaagagaaaataacctaaagcgtgttgccgtgataaatctgatacccgaggtcaacagtgttgtggttgtgatcgttatttttaattttgctcagcaacatttgggcggccatccgaccaatatcaaaacggggagtaattacgctggcgaggcttgggatcatttgcctgccaatctccagcccatgaaaacccgcaatggaaatttgttctggcacggcgaggtttcgctcgcggcacagcagaagcgcacccatcgcaatatcgtcattggtgcaaaatacaccgtctaaatccgggtttgcgctaagggcatcacgcattaactgcattcctaaatgaatggatgagatggcgcgtggattcatgcgtaatggggaaagattatgcagcatcatcgcatcgcaatacccctgataacgctgttcatcgcgggtgtcatctttggaaccgagatacagaattttgtgcctgactcgcttctccagcatggtacacaccatgtcaaaagcggcctgccgattatcaaaaccgacctccatatccagccgttctccctgtacatccatcaattccacgaccggaatggtggctgaacgcagaaatttcaccgtcctgatggtgtgatatttttccgaaagtataatcccgtcaatgttataagagagcaggttaatcaccgactcttcttcggaatcgcgatcgtaattgtaattagcaataagggtctgataattatgctcagaggtgacggattctattcccgcgagaatgtcagcgaagagttgattttgaaatgacggaatcaagataccgagggtataactttgtgcattcaacaacatgccgggagcgcgattagggatataattgatctcttccataattttggcgatgcgctcgcctgtttcctttgccacctttttcggcgagcggatataacgactcacggtcatttttgttacgccagccagcgtagcgatatcctgtaaagaaattctgtgattgcgcataacttctcccaacgtcgggggaatcttcaatcttcccccgaaactacatcacaatattttattctttcagtgcaatacggcgttaatggctaacacgcccagcaaacccataatagaaataagggtttccatcaccgtccaggtacgcaacgtttcaccaaccgtcagattaaaataccctttaaatagccagaagccagggtcgtttacgtgtgacgcgatcacgctgcccgcaccggttgccagtaccattaaagcgggatcggcatgggtaacgttgataatcggcaacaccacacccgcggtggtaatggccgcgacggtggcagagcccagagcgatacgcaacagcgccgcaacagtccagcacatcaataacggcgaaagtgtagttccggtcattaagtgtgaaatatagtgcccgacaccgctatctactaatacctgcttaaacgcgccgccgccagcgataataaacacaatcatcgcgatagcgcctatagaatccccaatgatatccatgatttgctcgatggtgcgtccattacgtcggcccagtgtgaaaatcgcaataacaatggcaataaacagcgcaacggcagggttaccgacaaattcaaagaagaggcgcacggtgttagttttcggtaacgtaatttcacaaacggcggcgatagccatcaggatgaccgggatcacggcagcgaaaatactgttccagaaggagggcatctcctcttcgctaaacagatgaggattaaataagccttccggtggtgctttctcaaagcgagttagcagtttagaaaacagcggtcctgcgacaataactgtcggaatggtaatgataaatccatacagtaaagtcgttccgagattagcctcaaagatagtcgcgatggcagtaggccctggatgtggcggcagaaaacagtgggttacagagagcgctgctaccattggtacgccaacatacaacaggggtaatcctgatgatgctacgatggtaaataccaacggcaacagcaggacaaaacccacttcaaaaaacatggcgaggcccacaaccagaccggtgatcactagcgcccattgcacgcgttttttaccaaaagtagcaatcagcgtagtggcgatacgttgtgccgcacccgtatcagaaatcagcttgcctaacatggccccgaaaccgaggatcattgccagcccgccgagcgtgctgccgataccattttgtatagagtgcaggacggcctgtgcatccatcccttcggcaaatccgacgacggcagctaccagaacgagggcaataaagccgttaactttaaagccgatcatcaggataagaagcagcgcgacgcctgccgcaataatgattaatggcatagtctttatctcttattagtgccagaaaagcagcgctttcgcgctgcacgtaggggggctgttaaacagccactaacatgccgccatcaacaaacaacaggtggccgtttacgaaatcagaggcttttgaagaaaggaacaccgcagcaccaatcagttcctgcggatctccccagcgtgcggcgggggtccgtttgcacaaccaggcggtgaaggcttcgtcctcaaccagtgctttagtcatttctgttttgaaatagcccggcgcaataccgttgacctgaatattgtggcgcgccagctcgacgcacatgccgcgggtgagcatttttaccgcccctttcgatgcggcataaggggtgatggtgtcacgtcccagttcgctttgcatcgagcaaatattaataactttacctgccttgcgttcaaccatgtgacgagttaccgcttgcgataccaggaacacggcggtctggtttactgcgatcacatcattccactcttgttcagggaactcagtaaaaggatgacggcgctggataccggcgttattcaccagcacatcaatggggccgatgtccttttcgatatgttcaacggcggcatcaatttcatgtttatgagtaacattaaaaggtgcggcaacggcctgaataccctcctggtggagtttttctacagcaagttctgcgcgttcggcagtaatatcattaataattatttgtgcgccatatttacccaggccggttgccagtaaaaagccaatgccctgtgctgaaccggtaatcaagatattttttcctgccagtgaaaatagatcgttcattgtattattcctttatttatctcttagaaaacaagctggacttttgctgcctgggttttatcaccggcgaaacgtagcgcctcttccaggtcagtgaagggatattcagcactcagtaaaggcagtggattgataacgccattcgccagccatgacactgcggtattaaattcgctggtaaaacggaaagagcctctgagtgaaatctccttaccaatcaacgtcatcattgggaattctgccatcgcgcctcccatacctacctgcaccattacgccgcgtgcacgagtgacctccagacaggtattcactgatgaaggatgaccggacacttcaaagctgacatcgaaatagcctttttccgctttccagtgatccatgtcgtcgttttgtgggtttacgagcacatccgcccccatctctttgcccagcgaaagggaacggggactcacatcagcacagacaatttccgcggcccccagtgttttcactgcactgacaatcaggcagccaatgggtccaacaccggaaataaatactcgcttgccctgtaactcgccggcctgatgtgcggcatgaatcgcgacggctaaaggttcggcaaaagccataaccttttcgtcagctttggccggataagggacacattgcgacgtttcgaccattttataacgggtaaaaccaccatcaacatgagggaaatacatggcactgccaaaaaaacgcatatctgtacactgattctcgttatgttcaatgcagtatttgcagtgaccgcacggtttagacggattaatggctaccgtttgcccttcatgtaattctgatgagtcgctatgaataactttaccgataacttcatgacctaacaccatcggtgcctttatcatgaaattacctacttttccttcctgataataatgtaaatcggaaccgcaaattccacctcgggttatttgtactaatgttccattattattccaatctatcgtctgctcggtaacggcaacagttttcttgcccgcaacaacgcaggactgtgttttcacttgcataaattcctcactggtcaggtagacacctcggaagcatttaagcggttttaactgtcattatttgtgatgaagatcacgtcagaaaattgttacattactatgttacgcataacgtgatgtgccttgtaattcttatcagtagaaataaaaaaacgtgaaattattatgccgccaggcgtagtatcgcagcaggtaagatgattcaggagattttaaatggcgggtgaaagctttattttgatgggcgtttcagggagtggtaaaacattaattggtagcaaggttgccgcgttattatctgctaaatttattgatggtgacgatcttcatccagccaaaaatatagataaaatgtcgcagggtattccattatctgatgaagatcgacttccctggctggaacgcttaaatgatgcttcatacagtctttataaaaagaatgaaacaggatttattgtctgttcatcattaaaaaaacagtatcgtgatattttacgcaagggtagcccccatgttcatttcctctggttagatggcgactatgaaactattctcgcgcgaatgcagcgtcgggctgggcattttatgccggtagcgttactaaaaagtcagtttgaggcactggagcgtccacaagcagatgaacaggatattgtgcgcattgatatcaaccatgatattgccaatgtcaccgaacaatgtcggcaggctgtgctggcgatacgacaaaacagaatatgtgcgaaagagggcagcgcctcagatcagcgctgcgaatgattttcaaaaatcggctttcaacaccacgcggtaacgcgccttaccgtcgcgcacatgctggatggcgtcgttaattttcgacatcgggaacagttcggtggtcggcgcaaccttgctgcgggcggcaaaacgcatcagcttacgcagctcataaggcgtgccggtagcagaaccagagacgctgcgatcgcccgcaattaacgtaaaggccggaacagacagcggcgtgagaaccgcaccgaccgtatggaaattaccgccataggtcagcgcctcaaaatagggctgccagtcgaggctgacgttgacggtgttgataatgagatcaaactgccccgccagtgctttcagtgcctgcggatcgcggctattcaccactttatcggcacccatcgccagcacttcctgctctttcgccggattagaactaaaggctgtcacctcgcatcccattgcgtgcagaagttttatagcgatatgccccagcccgccaataccaattaccccaacgcggctggtagcagtgatatggtgcatcaacagtggtttaaagaccgtgataccgccgcacaacagcggcccggcggactcgatatcaatattttctggcagtggaatcacccattgccagtccgcacgcaacttctcggcaaagccaccgcgattcataatcgtcggcaccgcaccttgctcgcagttgatctgattaccgctaatacaggcgtcgcagtgaccacagctacgcgccgtccagccaatcccgacacgctgaccgacctgcaaacctttatcctgcgcggcgctcccgagtgccaccacgcgcccaatcacctcatgcccggcaaccagcggatattgtgaaaatccccattcgttatcgatcatcgacagatcggaatggcagatcccgcagtaatccacctgcacttcaacatcttgtggcctcagctcaccgggatcgtactcataaacttccagttcgccgcccgcttcttttgcggcatagctttttatcatcgacattttttggtccttctctggtgttgtttgggaagtgtagagcatggcagggcggggtgcctggagtgtgacaaaggttacacatcgctgtatgcaatgctgaaaatttcagcacttagcgaggtgcgagcaagctggcgcttgcatggtggcgtgcgacaggtataatccacaacgttttccgcatacctcttcagtgccgaagtggcgaaatcggtagacgcagttgattcaaaatcaaccgtagaaatacgtgccggttcgagtccggccttcggcaccaaaagtatgtaaatagacctcaactgaggtctttttttatgcctgaaatccagtgtttatctatctttcccgctatattaactctctcaaggtcaaccgatatcaacgtacatctaccaacatatgttggtacagatgatggtatttccggttcgataatgcttgtaccaacagggagggaatacgatggcattaacagatatcaaagtcagagcagccaagccaacggataagcaatattagctgactgatggtggcggtatgcatctgcttgtccatccaaatggttctaagtactggcgtttgcagtaccgttatgagggaaagcaaaaaatgctggcacttggggtttatcctgaaatcacactagcggatgccagagtacgtcgtgacgaggcgcgtaagctgcttgcgaatggcgtcgatccgggagacaaaaagaaaaatgataaggttgaacagagtaaagcacgaacctttaaagaagtcgcgattgagtggcatggcaccaataaaaagtggtctgaagatcacgcccatcgtgtgctaaaaagtcttgaagataatctttttgcagcgcttggtgaacgtaatatcgctgagttaaaaactcgagatttattagcacctattaaggccgtagaaatgtctggacgtcttgaagtggccgctcgtcttcagcagcgcactacagccatcatgcgctatgcagtgcaaagtgggttaattgattataacccggcacaagagatggctggggcggttgcttcctgtaatcgacaacatcgtcccgcgcttgaattaaagcgcatccctgagttgcttacaaaaatagatagctatactggtaggccgctaacccgatgggcgatagaactcactttgctgatctttattcggtccagtgagctgcgttttgctcgttggtcagagatcgatttcgaagcgtctatatggactatcccaccggagcgggagcctattcctggagtgaaacattcccatagaggctcaaaaatgcgtacaacgcatctagtgcctctttcaacgcaagctcttgcaattttaaagcagataaaacagttttatggggcccatgacttgatatttattggtgatcacgattcgcacaaacccatgagtgagaatacggtaaatagtgcgttacgggtcatggggtatgatacaaaagtagaggtttgtggtcatggctttcgaacaatggcctgtagttcattggtcgaatcaggtctgtggtctcgtgatgctgttgaacgtcagatgagccacatggcgcgaaattcagtgagggccgcgtatatccataaagcagagcatctggaagaacggcgattgatgctacagtggtgggccgattttctggatgtaaacagagaaaggtttatcagtccatttgaatatgcaaagattaataatccattaaaacagtaatcatcccgggcaaatgcccgggaattattctaggattattttctttgttaaaaaagacaaacggtattaactgatgtatttactatttaccgctccctgcaggggggattatcagaatccgcggttattcattatttatatacattcaataaaaaagtaacctcataaaaaatcctgtactcacagggtgatgcgggataactgacgtaaggagtgctgcagggatttgatggtcccttgtagactggccccctgaatctccagacaaccaatatcacttaaataagtgatagtcttaatactagtttttagactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccaccttgtgctgatatgaatacggatattttatacagaatacttttcagtacaagcgactgtattacagtctgccatatatgattacctgtgatcaggaagaataagtggctgaggtttcaaactgtctgccggtatattcctctctcccttaaaaaccataacaggttagttatcttcgtctgtcagcggattgaatggcggtatattttcagtacaaataccggtcatccactgaaaaatacctgcgaaatgacgggcactgatttttctactgacgggctgatgagacgttatgtcactggcggtaataatcagtggcacactgtagcctccctgcacatgaccataatgatgaacaggattggcactgtcgctgaccgacagcccaaggccagaaaagtaaagcatggcgaaatgacgtgagtaccggcgaaggataccatcaagctggccaagaaagttatccagtttactgatgctggcgaggtaacaggcaatttttcggggatactgctccaggtaattattcggctaggagttaaggctgtcacacggatttggatgagaacccatcatgtgcaggaaaattatcttcggagaggatgtatccgccagcgcacgttctgtttcctgtaacaacagtttgtcatctgttttacgggaagcgaagctgcctttcttgaggaaagtggcatgctccgcatcagaagcaataacagagatgcgtgtgtcatgctcccccagttttccttgattggatatccaccatgtgctgtatcctgcttttgctgccagcgccaccacattgttgccggaatcagggttctgctcatagtcataaatcagtgtccggctcagggaagacactgtactggaggctgtcgaggtataatcgtcaataaataaaccgggtgccgtattcagccacggtgtggttggtacgggatagtcatacactgacatataatccctgcgcacactctcaccagtgacaataacaatcgtatcatataacggtgctcccggctggattttccagttgtcagccccgtgctactcagttgttcataacgctgcatttcacgtaatgtgtcagttgtccccacaactgttcctttaaccatccgcaatggccaacggtttacagagcataatacgaatagccgtagagccagccagttacggtggtcgcgatggtgtgtccgccagaaaatcaccacgaataccagaatcgcggcactgaccagaaaatgataaacaggaaacacggggcggttcactttgctttctcctgtagtgttttctgtaggttctgaaccggttctagcggggttgtgaggctgatggcaatcgccgggctcttcctgcatgttacactggtactgcaagagggggccttcgctcctctgacattactcagtattttcactactacaccccatctgccatccataacaaccgattcaccccctcgcgaggcgttgttgcccgtcacccggacagacaccgttatggacttctcttgttgcacgatcgatcaattgttatgcatgctgacaccacaaccccggtgggtatgaccgatgcctttctcactctcttcccggtcatcgtcggccttccccgttattgtggcgtgtcagcaccctcgacggcatttcgatggctgctcagtgttcactcacgttacggcccgcataacccgttgacttcctgaagaagtcgtttcagggagagattcagcccttttgttacctcctggaccgcttcttgtccttccagtcggagcgagagttagccggggcggactttcaccgacggaaagatcgtgcatttcaaggcacacacaacaatatctgcgagcgtgctatccgtccggtcgttatgggacgaaaggcctggttgttcgctggttcactggtggccgggaaccgcgcggcacagataatgagccttctgggaaccgcagtctggagccacatgcttggctgacggacgtcctgacgcgtctgccggagtggccggaggagaggttggctgagttactgcctcttgagggctttaccttcttcgggtaagtgatacctgccgtcaggtgtttgtgcaccgggccataacctgcagttgggaattgaacgcctgacaacaggaaatgagctagagcagtaaacacgcgggctgacaatgggtcagaatatgagttagcccggcgttattcctggggtcagtacttcagatctagcctccggtaccagactagctagcccctacgcaaccaaataaatcaaccatcgtcagagtgcaatcgttcatatacactgtcggtgatgcgctaaaaaatgcgttaatgttgagttcctcgaacccttaccaattaagggacatagccagatacgcaactggctgatgcaagcagtctaatgtctttagatccgctggcctgcgggcatgacaatgtcaaacagtcaaagattgtggcgttgacggtcagtcttggggacaaaaaagctcagtattctcgttggcaaccagataatttaacagttgatgctgaaacgaaataggcatcttggttctgtaatgccagtcagttaagcaactgactggctctttttcggggctgtggggtatttccagggcctctcctttaccactctcgggaaggccctttcccttcttgtcggtaatttcacaagttgtcccatacttgcaagatcgcgcatcagctccggtatacgtcccggtgaagcgccctgcaatgtcatcagcattctcatcaccattccgcatgattctgagaaactcagttgattcggccagtaacctttcagatgttccgccattttaatcatctgatatctcaccagattataagccagtaagacaccccacagctcttgctccacaagctccggctttttacttctcagcgtcagcctgctccgttgcatcgtctgttttatctccctgtatcccagttcgatttcccagcgatgactgtacagatcccccatttctcctccggggaagcgcatggcgtccgtcatcgacgtcagcagatggcagacttttcctttgcgcgtcacggtcagcaggcgggcagtcacttcatttcccagtcccggccacttttttcgtgcctgcgggctggttttcagcttcaccagatgatcgcctttacccagttttctgatctcttcatattgcgctccctttctgagaggtatcatccagtggcggtgttctcccgccaggctccaggcatttaacagtcccagtgagtaataacctttatccattaacgtcagagtgttatcgccggtttgttctataagttgctcagcaagctcattttcgctgttcttcatcgtgccgaaggctgcagccgtcagcagatggctggtcagttccatctggcagaccattttgacctgcgggtagagcgccgggttcccggcatgtgtctggcgggggaaggctgcatcgttctctggtgtatccggtgtgcgccagaacacaccatcgatggccagcagggtcaggccgcaccagtgcggatgcggcgtggcgttatgccagagctgcgctgttttcgtgaacacgcggcggacagcctcacttcccaggcgctggcgggcctgaataacggcactgggggcaacgaaggggcgattgcccggcagcatgatgtccaggcgattcacaatctggtgaagaggttctttacgctcaagcgccatgccaacaatacaccagaccatcatttcgaggggaagacggcgcttgcgtagcgttacagtacctgattcggcaaggcaacgagagatgagttcggggtcgaggtaatcccccagagaagtcagtgggttacgcagagaatcgtaacgggataccagatcaagagcctgtccaatgtgcataaaaaaatccggaaacaagtgagcgtttccggattcttacacagccactggatcggtcaactgatccttaactgatcggcattaatcttggttctggtgtttgtaacaaactatcagctacaaaaatatgctcaatttgtgacatcagtaacaaaacgcgttttgttatgtggattgcttgttttttgatctggtataacaggtataaaggtatacagaaaagcaaagaaatactgcaaaggaaaacagctataacgtaagctaaagtaataacctctcagtctttcctcatttgacgaagggagttttattcaacctgaacggactacgaaaatgagcacaatgaataagtcaatttttgaagcagggttgaactgtgccagtggtggaatatctggcgaacattgttttttgttggtgacccaaaactgtaggtgggtatcagttttatctttcatagagtgaaatatgttaagaagaaatggaggaaaagattgtactgattaggtattgataacaatcaatagtactggcgtatttgaagacaatataattatttctggatattgttgaggctccctaatatttactttaagggctatattagaataacacaggaaacaaatatggcaacagcatggtataaacaagttaatccaccacaacggaaagctcttttttccgcatggcttggatatgtatttgatggctttgattttatgatgatattttacattcttcatattataaaagcagatcttggcattacggatattcaggctactttaatagggacagtggccttcatagccagacctattggaggtggtttttttggtgccatggctgataaatatggtcgtaagccaatgatgatgtgggcaattttcatttactcagtcggaacaggccttagcggtattgctacaaacttatatatgctcgcagtttgccgttttattgttggcttagggatgtctggtgaatatgcatgtgcttcaacttatgcggtagaaagttggcctaaaaatcttcaatctaaagctagtgcttttttggtaagtggtttttctgttggaaatattattgcggcacaaataatccctcagtttgctgaagtatatggatggagaaactctttttttataggcctgttaccagttttactagttctttggatcagaaaaagtgctccagaaagtcaggagtggattgaagataaatataaggataaatcaacatttttgtctgtcttcagaaaaccacatctttcaatctctatgatcgttttcctcgtctgtttttgtctatttggtgcaaactggccgataaacggactacttccttcctacctggcagataatggagttaatacagtggtcatttcaactctgatgacaatagcaggtttaggaacactgacaggtacaatattttttggttttgttggtgataagattggtgtaaaaaaagcctttgtagtcggtctaataacttcatttattttcctttgtcctcttttttttatttctgtgaaaaactcttctcttataggattatgtctctttggattaatgtttacaaatttaggtattgcagggttggttccaaaatttatatatgattactttccaacaaaattaagaggattagggaccggtcttatttataacttaggggcaactggaggaatggccgcacctgtattagctacatacatttcaggatattatggcttaggtgtttcattattcattgttacggttgcattctctgccttattaattttgttagttggttttgatattccaggtaaaatttataaactatccgtggctaaatgattggaggctttatgattaattatggcgttgttggtgttggatactttggcgctgaattagctcgttttatgaatatgcatgataatgcaaaaattacatgtgtatacgatcctgaaaatggagaaaatattgcccgtgaattgcagtgtatcaatatgtcaagcttggatgctttagtctcaagtaaattagtcgattgcgtgatcgtagccaccccaaattatctgcataaagaaccagtaattaaagcagcaaagaataagaagcatgttttttgtgaaaaaccaattgcattaagttatgaagattgtgtggatatggtcaaagcgtgtaaagaagctggtgtgacctttatggccgggcatattatgaattttttcaatggggttcaatatgcacggaagttaattaaagaaggtgttatcggcgaaatattatcatgtcatactaagagaaatggctgggaaaacaaacaagagagactttcctggaaaaagatgaaagaacaatctggtggacatctatatcatcatatacatgagttagattgtgttcagcatttacttggagaaataccagagacggttactatgattggtggaaatttggcccattctggtccaggatttggcaatgaagatgatatgttatttatgaccttggaattcccgtcaggaaaactagcaaccttagagtgggggagtgcatttaactggccggaacattatgtcatcatcaatggaactaaaggctctattaaaattgatatgcaagaaacagcagggtcacttaggattggcggtcagacaaagcattttttggtccatgaaacacaagaagaagatgatgatcgtcggaaaggcaatatgacctcagaaatggatggcgctatagcatatggtcatccaggaaaaaaaacaccattatggcttgccagtttaataagaaaggagacgttattcctccataatatcctctgtggtgcaaaacctgaagaagattatattgaccttctcaatggtgaggcggccatgtcggcgattgctactgctgatgctgccactctttcaagatcgcaggacaggaaagtgaaaatcagtgagatcattaaacatacatcagtaatgtaaaaactatacgcctcttgatttaattcaggaggccttttatgtatgatcaagaattttatcttcgataatctcataattttagcagtgccatttatgataaaaacatcccttaaaaccaatctaatctttttcttcctctgtgtatttgttccccatatggcgtcataatttacgctacgtaatacgggatagttacgatacgcagcgatagcgctaagttttagttaaaatcccccatcagcgggatatggggatctctgggaggttcaggttttagcatcgcgactttaatacgacagacgctggtgacgatgatgccaagtagtgactcttccgaataaggttcccactgaccaattggcgcgcgcttcgcaataaaatctcccttcgcccagtattgggaaaagtagatacattcaaactgtgtacgctgtttcgtctcacagttcacgacattgctggccgatgagctgaccattgggcctatccgggctgtcccgatggatattacgccgaagtatgtgggaattgccagcggattgatgaacgccggttccgctgtcgccgacattatttcacctatcgcctttggcattattatcgacaaaacaggcaactggagtttaccattctacggttccgtcgcattgcttgttattggtatattcctgacgttcttcatgcgtccagataagtcattgtaaaagtcgaatcagggctgaagtggcacactgaatttggccacctgaacagaggtgatatgctcacctcagaacaacacaggtgctccaatgaaaaaaagaaatttcagcgcagagtttaaacgcgaatccgctcaactggttgttgaccagaaatacacggtggcagatgccgcgaaagctatggatgttggcctttccacaatgacaagatgggtcaaacaactgcgtgatgagcgtcagggcaaaacaccaaaagcctctccgataacaccagaacaaatcgaaatacgtaagctgaggaaaaagctacaacggattgaaatggagaatgaaatattaaaaaggctactgtagattcaatctgtcaatgcaacacccctttcaattatctctttcggtgttttgaacttcagtgtctttctcggtctgttgtttagctgagcagcaaccagatctagttcatgttgagtatattgggcaagacatgtctttttaggaaagtactgccgaattagcccatttgtgttctcatttgttccccgctgccaaggactctgaggatcgcagaagtaaactttaacgccggtgctgacagtaaattctagatgtctggccagttccattcctctgtcccatgtcagtgattttctgagttctgacggtaaactcaggaatttgtcggtaagagcctgatttactgagacagaatctttgcccctgagtctaaggatgatcgtataacgtgattttcggtctacaagtgtggctatatgagagttttttgtacctgagactaaatcgccctcccaatgccctagagagcgtctgttatcgatatttcgggaacgttcgtgaattggtgttccgttcactatgttaatcgtacctctttcgcctttgcgggtatgacgcctgccatggcgaaggctatgcgaccgtcgcagatgctgtatattcaggtggtgtagcgcttcacggctacgaaagtacagcgttttataaattgtctcaggtgatattcgcagcgttttttgacgtggttttgttcgccttaaccatcctgatatttgctctggagaccatttcatctccagcttttccagaacaagctttcgcaatggtaaattttgatccagtaagcacggttttggccttttcgccattctgttggctcggttattagcatcaacagctttgtaatagcgtctgccccgattacgctgaacttcacgtgagatcgtcgaaggactgcgattcagcgcagtagctatcgcacgaatgctcattttggctgacaaaccagctcgtatctcctcgcgctcagacagtgtcaggtgagctacagcccgcttacgctcatggggttttatgccgccagtatcccttaacatagtgaagatcgttccgggttttgaacccaggatattcgctatttcactgaagcctgttccgttcttccatagttcaaaaacagaggctttttcctctgctgtaaatgttcgtctcattcaaaaaacctccgcaaccccatgttttcacataactgttgcgttgaccaattgaatctacagttgctttttttaatatatctcgctcaaggcgagcttcatttaacgccttacgcagttgcagaatttcagattccagttcagccaccgtgcgggaaccaggagtaccgagcccttttctggcggcggtaacccattgtcctaaagtgccttcaggaagagataatcgggaagcgccttcactgatcgaaagttgattttcaagaaccgttctgacagcttcggctttgaactttttagagtaacgttgggtttttctgctcattattagctccttctgatgccattctatttcaggaaggagtgtccgttaaactcaggctacctcaggaaaaaccgtcctgaaaaaccagacggcagacgggctgtattacgcagtcaggtacttgagctacatggcatcagccacggttcggccggagcaagaagcatcgccacaatggcaacccggagaggctaccagatgggacgctggcttgctggcaggctcatgaaagagctggggctggtcagctgtcagcagccgactcaccggtataaacgtggtggtcatgaacatgttgctatccctaactaccttgaaaggcagttcgccgtgaccgagccaaatcaggtgtggtgcggtgatgtgacctatatctggacgggtaagcgctgggcgtacctcgccgttgttctcgacctgttcgcaagaaaaccagtgggctgggccatgtcgttctcgccggacagcaggcttaccatgaaagcactggaaatggcatgggaaacccgtggtaagcccgtcggggtgatgttccaagcgatcaaggcagtcattatacgagcaggcagttccggcagttactgtggcgataccggatcaggcagagtatgagtcggcgtggaaactgctgggataacagcccaatggagcgcttcttcaggagtctgaagaacgaatgggtgccagcgacgggctatgtaagcttcagcgatgcagctcacgcaataacggactatatcgttggatattacagcgcactaagaccgcacgaatataatggtgggttaccaccaaacgaatcagaaaaccgatactggaaaaactctaacgcggaggccagttttagttgaccacaacagactacctgaagggagccgcggtcgcctggcagttgcagtagcaggagatcatccagccgcagtacaggtcacgatgactctggttaatgataccggctttgaccccgtattttccggctctatcgctgaatcatggcgtcagcagccgtgcacaccatcctattgttgtgactgggaggctgccaccatgcttcgcgctttccctctggcgaaaaagggagaaggacgggcccgtctgccttcactttatgccagcttcggtaagctgggtgagacaccgactcatgaagatatcattgataacaatcgatccatcaactggcctgtataacgtggctgccggtgattaagaaagctgcacctacctaagtagtagcaaacgcacactttttagaaaaatcgatggtcagaaactggattagcaattccgttccatggttgcttttgatttacgttggcgtctgatcattgatttatcctcaaaagcccaacctcattggtaatgaaccagctccgtgaatgtccgctctggcacagagcgaaattttttgatctcccccctgaaatctaaacttagtcatgtcacgtttttgggtttctaaaattttaacttcgcgtttttcgttgccgtaagggttatacagaaatgtccgttaagcagagttcaaaattgattgccgtgatcacgactggtttgaaagccgcgcccaagcctgtacagctctggtttgcgttgattatgaacctgtcagcctaaagcaagcggatggacgatgagtattggtaatctttcagagtccggaaaagttcagccccagtctgaacaggcttgctggcgccagtccagtttcattcagtcgtggtttggttcttacggcctgtgcaatctacctcattaggcacatcggcctgccagataccggctcggggtgtatttccgcttccacgctgaatactgttctcagcaatcctggggtcatcacctcttctggtgtgccttgcgccataacatgtccgtttgccattaccaccagttgatcgcagtaccggctagcctgattaaggtcgtgcagcacagcgaccaccgttttcccctgagtccggagttcgcccatcaaccgcatcaggtccacctggtgattgatatcaagataggtggttggctcatcaagtaatacaacgggcgtattctgggccaggaccattgccagaaatgcgcgctggcgctgaccgccggaaagctcggttaaccgacgaacggcaagatgattgatccgggtctggttcatggcgacattaactcgtgcattgtcttcagcggagagacgcccccagagtgacagccagggattacgaccatacgaaaccagctcctggactgtgatcccctctggcgttaaatggtgctgaggcagcagcgaaagcctgcgggccaactggcgcgatgagagcatatttatgggattatcgccgagaaatacggtgccagactgcggcattaaaagccgcgaaaaacagtttaacagcgtcgatttcccgcaaccgttaggaccgatcagggcggtgatcttccccgttggcagtgagagtgaaacgtcgttaagtaccttgtctgtcccgtaactgaccgtcagattttcagttcgtaaagtcatttatcgcattctcacaagcaaccagacaaaccacggcgcaccgataatggcggtcagcacgccaaccgggagctccagtgggggatgaataattctcgccagcagatcggcaaccaccaacagcaacgcacctgtcagggccgaaacaggcagcagtctgcggtgacgtccaccggtgatgctacgcatcatatgcggcaccacgagaccaataaagctaatcgggccgcaggcggccacgccggtagatgtcatggcgacagctagtaacaaagcccagaatcgggtatggggcaccgacacaccgagcgtggtggcgcgcgcatcgccgagtgcaaggaggtcgagatcgcggcaaaaactcaggctcagcggcagaaataaaatcatcagcgggatggcaatcttcacaaagctccagtcacggccccataagctgccggtcagccacagcagggcgttgttcacatcctgcgggcgcgagagcatcagataatccgtcaggctggcccagcatgcagaaagcgccacgccggtgagcgccagcttcatcggctggtgggtctttgccagcatcttcagcaatatcaaccccgccatgccgcccgcaaaggccagcagcggcagcaccatcacgggcagtgacggcataagaagtagagcccccacagaggccaggctggcggcatggttaacaccgagaatatccggtgatgccagagggttgcgcacaatcccctgtatcagcacgcccgccacggcgagggctgcaccgacaaacagtgccagcagcaagcgcggcagtcggtactccatcaatacataataatgctcgtgtccggcctgccagtcggtcagcagcgcgcgccacggcacggggatcactcccatatggagtgataacagcgcacagcccgccagggcaagggtgatgaaaataaccagcgcaattttcatcctcgcctcctcacaagccagacaaagcaagggctgccaatcagcgccagcactgcgcctgcgggcagatctccggggaaggccagcgcgcgtgcgagtacatctgccagcagcatcagcgtggcccccagcagcatgctcactggcagtacgttgcgctgatcgaagcctgcccagaagcgcgccagatgtggcaccagcagaccgataaacgccaccggacctgctacgctgacgcacgcaccaaccagaagcagcactaacatattgatgaccaaacgtagcctcgtcaggttcactcccagcgtatgggcggtgctgtcgctgaggttgagcaggttcagttgattcgccagcagcaacacgacagggactgcagtgaccaccaccggcaagagctgccagacatcctgccagcgggcgtgggacactccgcctgccagccagtaaaagatgccgtaagcatgatcttcggccagcagcagggtgatgcgggtaaggcccatacaaaaggccgacagcgcgatacccgcgaggatcagtttgtttctgtcatgggtatgacgaaatccgcctcctgcggtcatgaccagcagccagctcacgccgcccccgcatgccgcgatgaatgacagagaatagcctgcaatcggcgtcggactcagcgcgctggtaagcgccatagccagcgccgcgccgctgttaatgccgagcagtgaaggagaggccattgggttgtgggtcagggtttgcagcagcgtgcccgcgagcgccaggcttgcgccgatcagaacggcgaccaggcttcgtggcaaacgaaggttttgcaccagcgcttctggtagcgttggcgtgtgtccaggcagcagggcgcgggttgcatctgctccggaaacaggaatggccgagtagcaaaacagactcagccagaaaataataataagtgctgcaacgggaagcccccacagcagcaccgggtgttttatcgcggtcatttcacaacggtaagcggctgatggtggaagatttttaccgtgtcagcggcaatacgctctgcagcaaaaataccgcgcatccgcgcccaggtgttactgtcgaccgaagcaacctgctgcttctgcgcggcggttaacatctgccagagcggatcttgttgccagcgtttaacaatgctctcttcgcgatagtgggcaaccagcagccaggcaggattgaccgccagcagttgctccaggccgatggacggcatggacgcacccgccatcgcagcgggaacgttcagccccagagaggccagcacgctgccggtccaggtctcctgagtatgcaggttgaattgctgttcgcgtgatgtgccaaaggccacgcgtgtccctttgggaagctggctggcccactgcgccatcctctctttatgttgttccagacgtgcctgcatctctcgctttttacccaccatttcgccgatgatagccgcagattgcaaattttcagcgtaggtttcgttgcgggacttaagcagcagtaccggcgcgatttgctgcaaggcgatgtaaacccccgcatggcgactgctgtcggcaatgatcaggtctggtttcagagcggcaatggcttccaggctcggctgcgcgcgcgttccgacggactgccacggtttcaggtgcgcacgcacttcgggcaggatgcgttttgcatcgttatcgtcggcaataccgatcgggatgacgtccacggcggccagcgcatcggcgaacgagagttccagcaccacaatccgttgtggcgttttttcgagtgtaaacgtgccgtgttcgtcctgaaccgtggcggcaaaggcgtggctgatcaccagcagcaggcctgcaaaaagaaaacggataaatgccaacataatcacattccagctaaaagcccggcaagccgggcgttaacacatcagaacttcaacgacccctgcatatacagcgtgcgcggctggcctgcatagatgcctttgttgttgtcgtcataagagcggatgaagtagtcctggtcgaagatgtttttcacaccgaatgccaggttcagatctgccatctgcgggccaaagtcatacgccacgcgtgcgccccagagcatgaagccgggaatgcggccggtactgccgtcggcgctctctttcaccgtattggcgttatccgcaaactggctggactggaaatcgctgttcagattgaacgtccagtttcctggcttgtagtccacgcccagcgtgcctttatgtttcggggagaatggtaccagattgccgtaggtgtcgcctttctcgcggatttccgcgttcacatacgcatagctggcgtagatggaaacgttatcaagcgttggcgttagcgtacccagatcgtaacgtgcctgcgtttccagcccggtatggcgcgttttgccacgtgcagtgacggtgtcgttggtctggttggagtcgtactgattgttaaagttaatcaggaacagccccatttccgccgtcagcgcgccgtcgtcgtagcgggtaccgagttcccaggttcgcgctttttccggttcaacattgccgctttgcacagccttgccaatctggctgtactgtacggtgccgaacgagccttcagtgtttgcataaagattccagctgtcagtcaggtgatagagcacgttcaacgccggaagcggtgcgttatagctcacttcttcgtgcgtgcctgtgatggcgttgttctggtatgactcgatatgttcgaaacgcatacccggcgtgatggtccagttgccgatgtcgattttgtcatccagataccaggcgtgcgcctcggtgccggaacgcgtatcgcggtcgtaagggcttgagccggacggcaactgcccgctgctggtggcggtgtagtaacgcatttcatgcgttgattcattcaaatagcgatagcccacgcccacttcgtgcgcggaagggccgatcataaagatctggctgtagcgtggctcaataccgcgcacccagtagttacgcggcgagagggtgatgcgtttgccttgctccaggtagccgctgcgcagggtttgggtgtagaacccctgaatgttgaatttatgctggctgtctggctggaactggtagcccaggctcgccagcttgcgacgaccccagaagcggtcatacgggcgggtggattgccagcgatcggcgtcgtaatccgcgcgagacaggccaccgggcatgtcggcttcaccgtcgtaatattgcagcaggctgttgaaggtgtgcacctcatccggcgcatatttgcttttcagcatcaggtcgtcgatgcgggtggcgctgtgctcgcgccagtcactgccgcgcgtgccggagtagagcagcgcggtgccaaaaccgttgtccgctgtgccgcccaccatcaggttgtgcgtctctttcgggttgttttgtgaagaggttgggctgagctgaccttccacgcccgcctcgataccaaagtcctgcggaatggcacgggtaacaaagttcaccacgccgcccacgctctgcggtccgtaacgcaccgcaccaccaccgcgtaccacgtcaatggcatccatgttgccgagcgaaacgggagccagtgaaagctgcggctgaccgtaaggggcgaaggggacggggatgccgtccatcaggacggtcgagcggctggcgaggcgcgggttcaggccccggatgccaaagttcatcgccaggtcgtggctgccggtgccgttgttttccggcgcgctgacgccagggatgcggttaagtacctcacgcatggtggttgcgccggttttggcgaaatcctcacggcggatcacgtcacgcgcgccagcatgttcaaatacgtcgttttcacgcgcatcacccagccagtcgccgaccacggtcagggcatcttcttttggtgcgggcgcgggctccagcgtccagctgttatttcccagcggttttacctgcagtccgctgccgtccagcagttgttgcaggccgctctcgacgtcgtaatcgccgtgcaggccgttgctctgcttgccgcgcgtcaggctggcgtcaaccgagagggtaaatccgctgtgtgcggcatactgattgagcgctttatcgagcgatcccggtgcgatattaacctgtgcagcaaaagcggaaaacgagagaccggccagcggcagcaggctcaggcgaatggtgttaaccaaaggtgttgttttacgaaaaacgcgtaacggcgtcataccttccccatcatcatttttgttgtgttcagctatgagtcgaacgagaagggtaaaaaggacaatcgaaataagaattattttccttacagtggtgaaatgtttatccagtaccgcgtaatagactgaattttaacgggaagcgtttgcgcgataacgttcaggatcgcatcggtatttttcagcgggaacgtcccgctcaggcgcagcccggcaacggcgggatcgcagcgcagcacgccgttgcggtaacgggttagcgtggctatcacctcacccagcggtttatcgctgaagctcaggatgtccttcgtccagcttgtactctcgtcatccagcggtttcactgcgccaaactcagaggcgctgaactgcaggctttcaccagcgttcacgatgcgtttttgcgcgggggcactggcgagaagcacttccacagcgtgctgctgcacgtcaagctgcgtgaaattatcctgctggcggacggtaaattctgtccctaaagcagtgagctggccctgacgggtcaggacacggaaggggcgttgcagggcatctttcgcggtagtaatggcgatttcaccgtaccagagccggacggtgcgctgatgcgcatcaaaacgcacatccgccgcgctttgggtattcagcgtgagcagggagccatcttccagttgctgacggctgactgtgcctttggcggtgcggtaatctgcccgcagaccttcgccggtttccgactgccagagctgccagcctccgccagcgccgagcaacagcagtaatcctttcatcacgtgacggcgggtgaggcgggtatcgtgcaacgcccggctggcaacgtcgccaggcacaccgccaagctggttgcgcaggttttcaacctgctgccaggcccactggttatcctgatcctgttcataccactgttgccagcgcgcttcctgttgtgggctgacgcgctcgccgcttagcacggcataccagtgggaagctgaacgcagcgcctgacggcgggaatcggttaacaaaggattcataacccatactccagacggaacagcaggcagtgctcgacggctttcgccacgtattttttcacggagctgatggaaacaccgagtttgtgcgcaatctcgctgtatgtcagaccatccagttgcgaaagcagaaacgcttcacgtgttttgccgtttagcccgtccagcatgctgtcgaggagttgtagggtctcgagttggctttcgcgttcctcaggtgaaggcgctcccccctccggcataagcgccagcatctccagatacgctttttccagcgcgtttcggcgaaacaggtccaccatcacgcgtttggcgatagtgcagaggaaggagcgaggatcgcggatcgtcgagagcgtttcgctgaccattacccgcaaaaaagtgtcctgggcaatgtcatctgcatcaaaagcagactggagtttgcgcgtcagccagcttttcaaccagccgtgatgtgtgccataaagcgactcgaacgttaaggaagctgtggtagtggcgcggtcagacatgcggagtgcatcaaaagttaattatcacgtagtcatattaatatgagaatggttatcattacaattggaaataaaattgtttccaatagacatttttaacatgttgtttttctaagtgttataaggtaggtataaaatgggatggagcctctgcttctggcatgtgtcggtcagaatgactcatgatgtggtctgctattattgacatcctcactgccctaaaggatggggatttcggtaatgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctccttgccgtaaaacatggcaactacagttcacttacaccgcctctcagcccggtaagcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggacggttgtggcgcacgtcttcggtgaacgcactctggccacactggagcgtcttctgagcctgctgtcggcctttgaggtcgtggtatagatgacggatggctggccgctgtatgaatcacgcctgaagggaaagctgcacgttatcagcaagcgttacactcagcgcattgagcgacataatctgaatctgagacaacatctggcaaggctgggacggaagttactgtcgttctcaaaatcggtggagttgcatgacaaggtcatcgggcattatctgaacataaaacactatcagtaagttggagtcattaccgaccatgtttatttcatacattgtgggtattgttcttattatcgccgctaatcaataaaatcctgccccatatctacatggggcagttgttcattcttttagtgtggtaattcacacgccagcaaaaactctgccgttccttcatcaacaatcaggtccgtgacatatcctcccagcagggcacccaacgttgcgtcatagcctctttccccaccagcaaggaagatcttccgttcaatctgccttagctgagccagactgattcccagaatacgctggtcaacatcagccacgacgggcatcccttccttgtcatagaagcgaccacaaatgacacctactgcgcctaaatcccgatacgtctgcatttccttcttattcagcacgcccacccgaatcaggggattttcatcaagcgcgttacccacgacaaaaaaggctttcgtacagcgagtcagaacgtcaaaattcgatcgaataataggctctgcctgtaactccatggccagtctggcgcttgataccacggcgggcacgtgcagcgaggcgacacggcctgaaagcttgtaggcgatttgcgatgaggattcaatgatcgtcaggtctggctgagatggcatggaaccgagcatctgtataacggtgacatttttacatgacttcggcgtcatggttttgctcatctgatggattgttcttccccaggcaacccccagcacatcaccattctcaatcacctgattcagatacatgccaccggcacgtgaaaggcgagtccgcatcagctttgtatcatcacgttttccggcatgttcgccatccggcacgatgatcactctctggagattgaatttatcgcgaatttgcaaagcagcgtcgatagagccaaagacattcacatccaggttgatatgaaccagtccattttcccgggctgtttgcaggtatttgacaaccgtgacgcgggacacccccatgatagctgcaacttcagtctggcttttgccttcctgatagtacagccatgttgcatgaagtacgggatcatcattgaacaggctgctgtttgtttgatctctatccacttttgtatacctgtattaaaccggggaaatgctcatcttaaccctgtttacccggagagttgatgcagattgccagtggcatgattttatacagatattttattcttttacatgaaataaaccagcataccatttgagcgatcgcccgctgttcccccatactgtaaagccggagacatgctccggctttacagtattactgagaatacacccatcaagcataatcgaaggttcaatatcgcccctttttgatcgccagcgattcgtcaccgtgcagacggttgccgtcactcactaaattatgggggacagtgaacaacaggttggctcactggcaagaacccgattataaaactaagctggcgagcagaataaaaatcagcccactgatggataagagtgtggacatcagcgtccaggataacagcgtttctttggtggtcaggccaaaaaagtctttaatcatccagaaactggcatcgttaacgtgagaacaaatacaggatccggcaccggtagccagcgtaatcaaggccaggttggtattgggatgtactgccaacaatgggatgaccagaccggcggtagagatcgccgcgacggtggctgaacccagacaaatacgcaggaatgcggccacgccccaggccatcaggatcgggttaatatccatacccgaaaccagggtggaaatatactgaccaacgccagagtcgatgagaacttgcttgaatgcaccaccaccaccgataatcagcagcagaccggcaatacccgcgatagcttttccgcaagaatccatcaggtcagggattgttttcccgcgccccaggcccatggtatagatcgcgaatagcagtgaaatcagcatggcgatcgttgaattacctaagaacagtatcacgttgtaaaataagcctgaatccgcggcacttttggcatgagtcatctggatgatggtgacaaccgccatcaggatcaccggcagcattgccgtgagaaaactgatcccaaagcctggcatttcgctttcgctgaatcggcgggtcgcgccgagagaggctatattcccctcttttttaaaggcgtccggaataatgcgctggcagaatttattcaataccgggccgcaaagaataaaggttggaatgccgacaatgataccgtatatcagtaccaatcctacatcagcgccatattccctggcgataacagtcgggccggggtgcggcggcaaaaaaccgtgtgcgaccagcaaaccagaaagcatcggcacacacataaacatcggtgatatttttgcttcacgggcaatagcgaataaaataggtaccagaagaattaaaccgacttcgaaaaaaagtgcgataccgacaataaacgccgaacagaccactgcccagtcaagtttatttttcccgaaataattcagcatggtcagcgctattcgctgcgcaccacccgcatcggccagcaagcgaccgagcataacaccgaagccaaatatcaaaccaatatggcccagcgtaccgccaagtccggattcgactgaggtgacgactttactcaaatccataccactggcgatggcgacagcaatcgagacaataattaacgaaacaaacgtattaagcttaatttttatggttaaaagcaggagtaaagcaatccctgccacaacgataattagtggcataacgtcctctcataacagggtagcgacccatcattatccgactgagcaaataacgaatgatgcagagtcggataattcaggtgtctggatgtttttatttatgctttcagtttttattcataaaatcgcgcaaagccgcgccaattttgtttacatcataaatacaaccggtccatgtcccaccactcacggcctgaagcattgcccatagccgggtatcatctggcaattcaggatcgggaagtaaatcctgatggctgggtctggcatttaatattgcagttgcctcctcctgtgaaggtaattgttcatcgctacgggttccgaggaaattgacttcgccgtgaagctcgcgacaatcaattttaatttcaattaaatccccggtgcgtaatttaccgatggggcctccggccagcgcttctggccccacatggccgatgcacgcgccagtagaaacgcccgagaaacgtgcatcggtgattaacgaaacatgcttaccgtatgacagatgcttcagggcactggtaacctggtaggtttcttccatccctgtacctgaaggtccaacgccaataatgaccagaatatcgcccgccttgatcttgtcatgtttgatatcgtaaatcgcacttttctcggacagataaaccttcgccacacctttatggtaatagataccttgctcatcaatcatcgaggggtcaatggcggtggatttgatcaccgaaccttctggcgcaatattgcccaccgggaaggtgatagttgaggttaatccgcgcgcttttgcttgctgcggagacatgatcacttcgtcagcgttgatttgttcctgatcgagcaggagttgcttgaaccgctgacgccgttcggagtgctcccaccagtcgaggttttctttcagcgtgctgccggtaaccgtcataacgtcttcatgcaacaatccgaggctgcgcagatgcaacatgacttccggcacaccacctgccataaaggcattgaccgttggatgataaaccgggccattaggcagtacgctcaccagtcggggcacgcgcttgttgatgcggatccagtcatcaacggtcgggatatggcaacctgcctggtgagcaattgccgggatgtgtaacagcaggtttgttgaaccaccgaacgcggcatggaccgtcatcgcattctctatcgctttatcggtgagaatttcccgggtggtgatgcctttttgactcaggttcagcgcagctcgcgcggaagctctggcgatctcccgccacacaggctcaccggaaggggccagggctgaatgtgggattgccagtcccaatccttcggccaccacctgagatgtcccggcagtgcccaaaaattgacagccgccgccggaagaggcacaggctttacagcccgcacggcgtgcgtcctgtagagataattcgccattggcgaagcgtgcgccaatggtttgcaccttgccgttgtcttctccatcctttgcgggcagcgtcgcgccgccggggaccagcacggttgcgatgttgtgctgcgcggcgagtgccatcatggtggccggaagccccttatcgcaactcgccacaccaataactgctttcgcgtcgggcagagagcgaataaggcggcgcattaccatcgatgcgtcatttcggtatggtagcgaatcaaacatccccgttgtaccctgagtacgcccgtcacaaggatcggagacgtacacggcatagggcagggcatggttggctttaataacctcggccgccgctttcatctggatgtccagttcgtaatgcccctggtgcaacgccagcgccacgggtttaccgtctgcgccgcgtaagccaccgagtgtactgagcagtaaaataccgtcccgatccagctcgtccggagaccaacccattccggcattcatggtcataccgaacagatccccgctcgggcggttgataagcatctctgcggttaatgggagttcgccgtccgggccatcggcgtgcgttctgacggtgtaaatatcgtggctctcgtcagcaaaaatattgcgaacagacatgagtttctcctcagactggtaaaatgccctgcgcggtaagcagcacgtggactttatcttttgcttcttcagatgcttcaagaatcggtggtaagcaatatgtctctacaggcagcccgacacactgcatgctgtatttgatcagtgagacaaacggtgtttcgagggcgtaaatagcgggcagttgtagtagttttttattcagcgtcgcagcggtcgccagatcgccttcacgccaggcgcggtagatgccgacggagagttccggagcaaagttagcgctggcggttatcgcaccgtcgccgcccagcagcatcgtattcagcaaatgatcatcgtaaccgcagaataccgaaaacgacgggcgtaccgacttaactgtgttgatcatcgtacgcaagtgaccaacgctgtcgatggtgtctttgatgccaacgatattctcgttttgcagagccagacgcgtcacggtttccggggttaagtcctgacccgtcagatccggaaagttgtacaggatcaccggtagggtgacgctacgggcgatctgctggtaatagtcgtcaagatttcgtggtgcgactttccagtagtaggggttgatggcgacgataccatcagcgccgtaggcttgcgcatgctgcgccagtttgaccgcttcgtcagtggaaggggaaccgacgccaatcaataccggcactcgcccgtcgacaatggttacagcttcttcggcgagtgccatgcgctgggctgtattcatttggctaaattcaccaccggtacccagataaaacagcccgtcgacccctttattaatcaggaagtcggcaacttcgcgcattgcctttttatcaagggttccgtcacgatgaaacgtgctggataccggtggaataatgccgctgaattttttcattacctcagtttccttttcgtaagtgctcattttcgtttctgtatcccagcccatatgatatttgctcagcgcatttccggagcaattccagatagctgtctatcttatttcctgaataaactaccggatcgccagaaagtgagattgcatagttaactctgttatacatattgaataccggcatacttaaacataccgccccataggttgattcttcgttgtctatggcccatccccgaaggcgtgttttttgtaattcttccagaaacaattttttatcggtaaatgtattgcgcgtatgtggagttaacgtgagtgcttctaaaaaataatccagttcttctcgtgtcttccaggctaataatgccttacccaacgcggtaatatgcaactcaagttttttgccaatccagcttttgctcgtcggtacagagtccggactttcgatcttgtcgagatagatagccgaaatgctctccatcgccccaagatgacaaaccagtccacttttcagcgacaactcctgcattggccgcttagtcacctcaaatatattttgacggtgtaacgcctgacaacccaattcgtagttttttattcccagtgaatagtagccgtttttgtttttaattaagaaaccacaatccaccattacattcaataaattaagcaggctgcttttggggtactggaatttatttaataactccatataacttgccataccaacccatgcaatgtgggttaatattttttcagcacggactaatgaattacaccctttgcgaaccataatggctcctccttgctcatggaataaatggtatcggcattacatagtggaaaatatgctttgttcagcatgctgaaccgtaatgatgtgattaaatgtgatcttgtacacactttgaataatgaatccagaacagccacatttagtgaatgagaataaaaagtagatggcgtgttgttgcaacatcgtagtgtgtggattgcgcctagagcttctttattcgttcgagcgcatcgccaatattttctattgggtgccattgattatttttgcttgaaatccctctcgaatgaacttacttatcactttattgaatgaggtaaaaacaactgacatccggctcgctgataacgctgtgcaatagtctcaggtaacccgctgtcactgatgatcgttttaatacatgatagtgttgctacagcatgcggctcaacggcatcaaattttgagtgatcggccatgagaataacttcacgcgagcgttgaataatccgtgttttcaccccgacctcaaacatggtggcattggtgatccccgtctccagcgacagcgcatcgcaggagataaacgcacgttctacggaaaaggcattgatcatctccagcgccagactctctcctaccgaaaaataacctgggcgaatcagtcctccgataatgtaactttccacatggggaaaacagcccagttcattggcgattttaatgtcgttgcagatgacctttacccgcgcatcggccaggcatttcgccagttcgaggcaggttgagccggagtcgagaaaaaagcagtcgccatctttgatcattgttcgggcaagggcagctatttctcttttcgccacagattgcaatgtacgtttcacgtcgaagacgtactctttgtcgtctgtactgtcgtcgaagtccaggcaaccgtgaccgcggatcatgcctggatactggttgacaatatactggaaatcacgacggacagtcgcttccgcatagccaaaaagctccatggcctgctgtgtggagaggtgacgatgttgccacaggtagtgcagcatctgtttgatacggtcaggtctctgttggctcatcagaaacaatctcctcttacagggtggcgaattgagctaaggtcgcgcgatagtcagatgaagagaacagggcgcgcccaatcaccatatgttgcgccccagctgctgccagttgctgtgcagctgccagcgtaattccaccgtcggcccagcactcggtctgaggaaaagccgtgcgtactttttggattttctcgcacatggagggaataaaccgctgtccctgcccatcgggctcactggtcatcaccatcactccgtccagctcagacgccagatatcgccaggcgtcgatcggggttgccggattaaataccagtccggctcgtgcgccggtatggcggatctcagttaacgtttccgaaggatagtccagcgtttctgcatgaacgaagatccacgcgggtctgatttcagccagcgcgttaaaccagcgctgtggccgggcaagcatgaaatgaaaggacaagggatgaggcgtctgtctggcgacggcctgcaccgttttcatcccaaacgtaatgttgttaatgaagctgctgtcctcaatatccagatgcaggctcccaaaatccagattgtccaatgccgtcagctcacgaccatagtgcagaggatttgcgctggcgagagaagggtgcaggatcataagcgcctccgttaacctgataccagcgcaaacagtgcatcgtctgtgctggcatttcccactgccgttaagcgttgtggcgaatcaataaactggctgatgcgctgaatggtcaaaatatgtgcgttggcatccgtggcgctgacgcagagaagcagccagacggggtcgcactcctcgttaccaaaggcgaccggggtgcgtagcgtggtgatactgacctgattatagtttgcgccttgctctggtcgggcgtgaggcaaggcgattcctggggctatcagataataaggcccccagttaagggtattttcgatgatcccattaacgtagcatggctgcgcggcaccataggctaccagcgggcgggtggcgatttccacggcctgacgccagtcggtggctttacgttgtgcctgtacccatttaatatcgttaatcatccgtcgttgactccatgccgattcgggttaatctggtagcgatccccgtcgatacttttgacgaaggcggcagggatcgcagaagggttattgctctttgccggggataagcgctctgcttatccccatcttatcggcgtatatgatgcactttctccataaactgactgactcgcgcctggtcaacgaaattggcaaaaacgccgtcctttttaaaggtggttgcggtcacacagccatcggcgatactgagttgttcctccacgttttccaggcagacgcccgtgttggccaacacgacggtgtcaggcaccgtttctttgacccgttttaacagcgcgctgtcggtacgcgtcccggcggtcaggccagaaacacagagcgcatcaggatggttgttaaatactgtcgatttagcaatagaacagatatcgcgattgcccagatacacggcggcctctgggacgatattgaacaaggttttcacttcgcctgcaccaatccggtgttgatgacggatggtctcaccgacgttagtgtcccagacgccaaagtcgctggcataggcaccggtaaatatctcgcggataaacttagcgccggtagccatcgccaggtcgaatgaggcgaccggatcccacagaacattcacgccaaacgggatgcggatatcgctcattaattgcccgatgattcgtgccattgccgcagtggtttccggacgcaccttcgtgagatagggaagactaaactcgttggagaacatgactgcatccaccccaccattttggagcgccatcagatcgtcccaggctttgtcgataacccagttcatccccaactgcgcatcaaaactcgggtcgccgggcaatgcacgtagatggcacatggcgatgaccgctttttccgtcccaataacctctttcagccaactcattgaaagtactccttattccgataattcacgtttacgtaagaacagcacgacgctggcgacaataccgaccgccacgacaacgccaataatcccaagcgacatcaattcagaaatcgaccaaccgaacatattgcccacggacaacgctgagatttgcgcactttcaccggcaaaactgaaaccgcctttgagcgccatttcagtgaagtaaggcgcgaactgggtggcgatcagcaggacggtaatcatcacgatgaccccgcttatcaacgtcctgaccaggtctccgcggtggataaccgtagccatacagataaagaacggtgctaccggcaggtctgcgaggggtaacactttgttgcccggtaaaatgctggccagaattaacataatgggtatcagtagcagaccgacagcaatggtggttggatgccccagcgtcacagcagtatccagaccgatatacacttcacgtcctttgaaatatttctggaagaactttcttgcaccgtcggagatgggcagcaggccctcaacaatcaggcggatcatgcgcgggaacaacaccatgattgccgcaacggtaatcatcagactggcgcaacctttaaagccttcaccagccgccaggccaaaaatcagaccgagcactacgccgataatcaccggatcgccgaccatgccgtagcgtttctggatctcctgagcatcgatattgcgtcccttcatgaaagggattttttcatagatagcatcaagtagaacgaaaagcggtactgaactggaaccgtagccttgcggtatcgaaataccttccagcccgacgatgttctgtacccgttttgccgtccagtcggccatttttaacgatagcgccgcatggcagattgcccccagcacaccataaatcaggctaccggtcataagctggaccaccgtacccgtaatggcgtagtgccagtaattgtaaatatcgacgttcatcgttttggtcagacgggtgaccagcatggcgacattgagaagaaaaataactgggataatcatggcgccaatggctgtcgcataaccaacgccggaggcagggcctgcgccaacgtcaaagacatgcagggctaggccgaaacgctcaatcatcactttgatagggggactgaggctgtcgatcgccatgacgatcaccagtcccataccgacaaaaccaatcccaaccgttacccctgccttaatcgcctgcagccaggggatgcggaagataaggccaatcacgatcatgatgatagggacgaaaacggtaccgccgagagacaggatgtaatcaaacataatgcctccttttattgagttaacagagccttgatttgttgttttaacgcgtcgtcgttgatccctgtgagcagggcggcgccattaagcgtagggatgccgtaatcactgttggttcgcatggaggttacaataaggtccataccgttacagttaagagggatctcattcagacagcattgggcggtagtggctgaaatgccctgttcagtcaggaactcttgcagcttgtgtgcaatcatggttgaagtcgacatgccggtaccgcatgccacaaggatctttttcataatggatgtgcctcttgtgtagtgcctgaatcaggctcaacggggaaatgtgctgctgacatacctgccagagcggtcaataggcggatgcaatcagtcaaatcacgcaggctggcaacctccgccggagaatgggtatagcgacaaggaatagagagactggcgcagggaataccatcctgctcaacctggatataaccggtttctgttatcacgccgggagccacttctcgctgcaccggaatgttgtgttcaagagccgtctgttccaacatccgtatcaggcgaggaggcgtgattaatccggccagcgttccccgaccatggtagttcaggcaggtgatcccaacgccctgattaatcctgacctcggaataatcgtgtaaatcaggggtgtcacacgatggagtgatatcaataccaatcgccaggtcaggttttacacggcgtaatacgggaacaatgccgcggatattaaattcttcctgtaccgaagccaccagataaacggcgatatcaagctccatagtactgatagcatccgctacaccgagcagggcagtacagcctagacgatcgtctagtgctttactgcacaccagatcgtttgccaggagttgcggcgggttatacagagtgacaggcgtaccgacctgaatgcccatccgtatagcgtcgtctttgtctttggcaccaatatcaatccacagtttgtcgacagaaggtgactgcgtgcgctcgtcgcctttggcaaagtggtaggacttaatgccgatacaccccatgactggccctttgtccccggtgagggtgacgatggaaccagccatagtgacctgcgcaggaccgcctacgcgttcaaagcgtaaaaatccagacggctctattttgcgcaccataaaaccgacttcatccatatgcgcaaaaatcatcagtcgcagcgcatcgggtttatcactaccgtagcgcgcgacgacattcccaagcctgtctcgccagacctcttttgcctgacgcctgaattcgcacagcatgacgtcagcgacagcgttttcgtgtcctgaaatcgcattgtgctgcaaaagcgagaacagggtttcctgcacagaaaatgacatagctatctccgtagaccgtaaaacaatcactcgttgagcgttttataggcgcagactggtcgaataattgtgagaacgttcacgtgaaaacgcgcaaagctgaacaaataaaaaattatgtgagccgagtggaataaaagcgctcaacgtttgtgaaagttacgggctggagagaccagtgattatggttgaaataatgaggatgaataaaacgcggtaactgttatagcaccactttgttgcaggacgctccctcttcattacgtcctgcacgtggataccccagcatctccatcagcggatcttagaatgtaatggcgcgtggcaggtcgttggttcccagcataatgtaagaaaacatcggatctcctgaatagattcagagggagtatagataatcagctcaaatcactctccgctttatgagcccaggctggcattgccgtcagataacgttttgcacgcttatgtgcttcctccgggccgactttttgccaggaatcaaggaagctggctaaacctgataccgcttcttcccagggtttgagattgccgttgctgtcgctgcattacgcacaatattgatcactggcactgtgtgcatctggtgccgacatcggcattccgcaagcctgacagaactgttcatgttgtgacatatgatgctccttatggtgacatcttgattaataaacatactgaatatgtattgtgcaggtgatacatcagatcaaagcaaaggtaaagcctcgatatttccagccagaaataccgggaacctgttgttaccgggcgatgagtgcgaacacgccccagccaaagcattcccgcgcgtaggtcacgtagcgtttcggcgcgatgtttagttcggccctgacttcggcggcgaagtcatcgtcaggattcgcttccagccagcggcgcatggtcagccattttgcggcttcataccggtcccagccttcctggtctgccagtaccatttccaccacgtcatagccgagatcgtcgaacgctccgacaagtcctggcagcgtcaggaaatcgcttgtcgagctgacgccgcaggcctgggctatttcttctgttgctggtagctgacgccagtagggttcgccgataagcatgatcccgcccggtttcaggctttgcgctagcagctcctccgccccggcaaacccaccggcaatccatgtcgcgccgacgcaggccgccacgtcacatttttcatttgcgacgtaaccggccgcatcgttatgaataaaatgtacgcgttcgctgacgccgagttcttccgcgcgacgctttgcctgcgcggtgaagagcgaactcatgtcgatgccagtccccgtaatgccatgatccctggcccaggtgcagagcatctcgcccgagccgctgccgaggtcaagaatgcgggtgcccggcttcatgcgcagcacgcgacccagcgtggcgtacttctcttcggtgaacgggttatggatgcggtgttcactttcgctgatggtaaaaatacgtgggatatccattatttaattcctgttattgggttaagccttaaaaaggacacaacaagattgttattcacgtcagtgctccggtttcatcagggtctgcgcaccggatgtggccggtcagggtcatgggctgagcggtgagtgattgcatcatccagcaggctttgtgctcctccgggatgggataaggtgccggatagcctttgtctccggcacagggttcgaacccatgtcgggggtaataggtggcgtggccgagaacaaaaaccgtctggcagcccatcaacctcaggtgctcgatgccagtgcgtatcaaccgtcctcccacgcccatcccttggtattccggtatgaccgccaggggagcgaggatgtgcatcaacggtgaatccatttctcctttgaaggttgcccgggtaaataaaatatgcccgacggctttgccttcataccgggctagcagcgataacgcggggcgcgcgctttcatcctcaagtaaagaggccactaaatcggcttctttgctgaagccaaatgcgcgggtttcgacttcccggatatcactggcatcacttttatctgtgatatgaaaagtgaagtggtgtactgtcatagaaactctccttagcgattatcgagctgagcgcgaactttattcagctcggtggtgttgattcgatagggctggccattgacggacttgataagttttttggttttgagttttttgaagacggcgagcgtgcagtcggtcagcaacagcccttcgcggctgtagcattcaacggaagtgacgcggcctgaagaatcgcggacgtgcgcaatacgtctacctttagcgagaacgtgtaaggtatgttgttcctgacgggataaattcatactgaagaacctatttaatcatcatgtgcaaaacgtgcaaacacaccgcggtgtccgcattcgatttcggcgcattgataatcagtccggcctgaaaaggtcggggaactgattatcggatgattacattctccagcatcaaagcctcgggttgagttgaaaggtatttacggagcgaatattaacacgtagttataggagggatatgtttcagtagaaaaagtgtgatgtactttggaaattgaatgccaacccatttactggaaaaggcagatgacactgacgaatgcatgttgaagtacgcctgaaatggcctcatcggcttttcccttcgggagattattctccttttgttaaatccagaacataaatatgctcacccatcttcgatgcttgaaaaattgaagccaatcctgataagtaatttttttgaaagggtattttccggattcacaccggctttgatgagtgaaaaaccgttctcttttattcagtcaatcgtggcggtaattgcttcaattgcatatccctggcgagcataagcgggactgatggtatagccgagccaaaacacatcgcattgctgacgtaaatagatatcaccaatcaaaacctgcgtcatttgttgacaatggccaattgaatatcgcgagcaagtgtaagaactcccagcaagaccctgtaaataattctgtgtaactgcccacgattaaaggtggccgctcaggcggtcaccgtattcgataataaatgggtctggaaaaagtgcagcatctggcagcgtaatgcaggtagcccagttcaactctcactaccagtatgatcccaagttcgagcgcggaatgtatctgtatgagcatcgtcgctgtttcaataacatcatcgactactgtaactcactttgctatcacggtaagttgcagcctaaaagagggatggaaaaaggacgattttccccgcaatgggatatttacatattgatggtagaggcatgaagccaaatggagggagccgtcataaccctcttgaagctgaaacaatagcagcatggctggtggcacataaggatgatatagagcgccattacggggaaccactgtacaaagttgttggtgttgtgacgccattttcggcgcaggttaatgctatcaaaatgtcattgcgtaagctggaaattaatggcaaagacgagcagggtttactgacagtggggactgtgcactccttgcagggggcggaaagggcgattgttctcttttctcctgtctactcaaaacatgaagatggcaggtttcttgatagcaacagcactatcctcaatgttgctgtctcacgcgctaaagatagttttctggtatttggcgatatggaccttatcgagatgcagcccgcattttcgccgcgagggttattggcaaaatatctcttttcttcagataataatgcgttgcaatttgagtttcagaaacgacaggatttaatttccgcacatacacaaatttcaacgctgcatggtgtggagcagcatgatgaatttttgaacaagactcttgccggagctcaaaagaaaataacgattatttccccttggttatcctggcaaaaagtggagcaaacgggatttctggcatcaatggctttggcccgttcccggggcattgatattaccgtggtgacggataaaaactgcaatatagcgcatgtcgatgatgataagcgtcaggagaaacaacatctgctgaatgatgctgttgaaaagctcaataagatgggtatcgctacgaaattggttaatcgtgttcacagcaaaattgtgattgaggatgaagaactgctgtgtgtcggatcttttaactggttcagtgctacacgggaagataagtatcaacgatacgatacgtctttggtgtaccgtggtgaaggcgtaaaaaatgaaataaaggcaatatatggtagtctggatcaacgtcagctttaaatgtgatgagccgttcatgatacaggagtagtaaagggcatattttaccaatgttaaggcgactttccgttttattgcgagtcgcctttcctgattataaatcttattgtttacctaatcattttcctttgcataatgcgcctgggattaatggcgggtgcttttaggaatgaaagaaaatgcaagcaataatataataatggcctaatttctttgaacatcattaagcatatcatcatcgtctatttgccagaatccgtcgacttataatcgccagaacggcatatcaggacggtgctgcgaacgctgtggcccaaaacgttccagtaaactgtgtagatgttcgtagatttccgagccataatcgaaaaggcgcggatgtctattaaggcatccggctaatctgtaagcaataacaacggtttatgcggtgcgcgtttttcacccttgtgccagattattatattggcaattgcctgctgttcgagcccgcaagtgaagagatattaccttgatctcatttgttttttgttgtctactctgagaacgaacaaggacatcccccatgaataaactccccgctcacctttcgcgccaaaactgcaaaattgcttctacaaatctgtcagaaataatcccccgacgggctgcagtgctgaaatgactgcttcgcagtgccgtcgtccagttctccggtgaccggtacgctgaaccgtaatatcccgtgcttaaatcgtccgggtcttcatcaggcgcgttcgtcagtcctctttcaccttgttgctggaagtcgacgaaaataatattggctaaaacattattttgataattgccataaatagcttcatacgaatgcgggaaattttctttccagtaccaggtggtatcgccgcaaaaccacggcgcgtcagtaatattattaagctgagaatggtattgttttagatccctacgaaaggcttcaaccatatgattaaagtgttgagggtgtgacgcgtagtcactggtcattaagtcaaattcgccttgcatccagcatgcgccgaggaatttgttctgcggattttttgccagtgcggctcgcgttctgctgactaaatcctggtacagcggagtatccgttccccaacgacaagcatcatggctggctccgtgccgttctgaatatgtcccttcgctgcccgcggtaaaagccgatccgccacggcaacacggaacgataagaatccctgcattatcaggaatgaagggcagtaatttccgtgcaatatgcagtgcctggccaacggtgccgtactgtgtttgatgattcgttgccagaggatggtgataaccctgcatatcctgaacatcgtgtgggcagtgagtcagtggaataatgtcgttaaagtgacatggcgggcctccgggatgcgtatgcgcaaatctcgctaattgtttaattctgggatgaggcgcatcttccctgtccggtaatggcagtccttcgccatacgccatggcattagactgaccagcaacggtaagaacatagtaataatcgggcgatattattgcgttcatataaatttcgcgtaattgaaatgacaaattgatagcagggcccctttaccggggccctgaagcgttagttttgtactgtgactttattatccttcacagtgatcaaaactgaatccgtcaccgctttgccgcctgcagtttcaccgccaataatcaatagactattattccagggcaatgatactccgtaggcccgaccttgcgataattcacccgatttatcccatttcccgttatgccaaagatgaatatcagtgctatatgattttttcaggccttcatgcgcatagttcttaccgttctggtaattttctcgtgaacctttgaatccggcccctccggcaaatataagagaatcattgcttatccccgcaaaaccgccagctacgccatctggtgatgagacgggagcaagcttattccattttaaattattaccggtgaaatcaagttcaaatacggcatccgttcgcaatcctggtttggcttcgccattaataagccaggttttatcacctttattcacaaccgccgcaccagccgttccgtaccagggcgattcgccagcgtaactccattgctgtgttgagggatcaaaagacaacagaaacttattgaagaaataatcttctgcttttttgtcaaaatagtgagcattgattttatctatagcggttgaatcttttccagcctcgttgagatcttcaaaatagccattgaagatattctggttaacaccaccagtaacataagccttgccgttgtgtacaaaagtcacatggcccgccatgcccatcggcgcgtgcgacatcaatttaacccaactattggttttggggttgtatttgtgtacgtcattaaatacctgagtcaagccctcgctgtttttgccaatgccgccaaacacatacagattgccatcaataaatgcagaggttgcttgatctcttggtccgccagggaatgcagctaacgctgtccattttttatctttggcctgtgtatccagcttgtaccatgccgtacctgcgctacctaaaccaatgtagacagtgtcgttatcaattgctccggtaccacttttaaatggcacaggagtttccggtaatacagacgcgtttgcggcaaatgaagccatcatgatagcaagcgccgttattgttttattcattgtgactgtctcctgtctactacagtttaaatgacacaccaatgcgataactgttttccgataaattatctctgccgttgtaaacaccctgacggtcaaggtagtcatattctatgtatggcgtaatatcgggcgtcatatggtattgtagaacaaatgcattttccgtcgcccatttcttatggtttgcatagcgataatcgttctgtttgctgtatagcgtcgtttgccatgcgaaggtgaaatcactattaatatggtaagtgacatatccatcccaacgatgaacgttatcacgagacatatcaccggataagtcttgttgtcggtaagctttccagtcgtaacgatagcgaatgccaaaattaagatcttttgtcgcgtcccaggacagttttacgtagggtccgtagcgtgtgccgttgctgctaaaatgcgttaacattcccgggcgcaccgtccattgatcatcaagtttaatcgcgtaattaacttcaacctgaacatcattgagtgcggcattttcctttttattatcatgaatggtattccaggtattactttccatgcttgcccaccatccattttgccatccctcactgactttgagtcgagtctcataggcgtggcttccactacgatatccaccacgtacgtccagtgtcgcagcctgagaaattaatggggacgaaaagcacagtaataatacgccagaaagtattttagcctttttcataaatttcactcatttgtaggatacagaaagcaatacaaagcccgcataaacaattagcatttatgttgtgtaatatttttttgccaggcttatagtgtctttggcaaccggtagctgtattttatatttttttgtataaggtctcctgtgaaaaatctcttttcacattatttaaataaacagagatccagattaaatacctgagtataaaatctcttctgatgtttaattgatttgaatgttcgtaagctatatcacttactcaatccattttacccagagtcataaaatagaatgtctgttgatctcattttcatattcctttcagactgaagtgcgttttcatcacccgatgagaaagaactgaagtgatgtttgccatagattgcgagatgccctgtctcattgactatcttggtgcacctttatacctgttataccagatcaaaaatcacgcaatccatacaacaaaaccagatttgcaattcgtgtcacaaaatatgtcgatctttttctaagaggaagatgccatgtgaagccagacgaacacttgcggtggtcttcaaaaactaaagatcttagtttaactatttgttttataaataatttattaagagtctaaacaaggggagctttgcaagctaactcagtgagcttggtgaaaatcagtgtttacccgccatcaggctgagcataattctcatcatgaaatatgtttcctggtttgtggcttgtaactggtcacttctgaagtcgatctggagaggcttgttgatgttggtgttttcaggatgatgtttcacttagtttgtttgccgtatcgcccggcgaatggctgtgattgaggaaggtttaagtcgtagtgaccaaagctatatttaccaacgaatgtagatgaaaaaatcatctcctgcgttcccccatatctctaggataaaaaggaatgtaacaatctcatggcgtaagctgacgaatcagcaggaataatcgctagggacctaagaattagcatgataatagccactaagaaattactgcgctccatgaaatagccattttgtggcaaatggagttgactaataatgtcatatgtgagacggctagttgaacgaatattaaattttgctgaattttttatgttgattttacttgttacagaacatatcacatgatatatagataagattagttgcattaatgatgagggttattattagattcgtatccgattgataaatatataaaggtacatagcatgcaagagcatggcgtttgtatggcaacgttattataattaacagttgctactccatttaagttcactcagaagaactggtccacttacgttagttattaagcaaacgttcgcttttataaacataatcaggataaaaatgttggattattgctaacccagcacagctagtgcgcgtctgtaattataagggaaaaacgatgaagaataaggctgataacaaaaaaaggaacttcctgacccatagtgaaatcgaatcactccttaaagcagcaaataccgggcctcatgcagcacgtaattattgtctgactttgctttgttttattcatggtttccgggcgagtgaaatttgtcgattgaggatttcggatattgatcttaaggcaaagtgtatatatatccatcgattaaaaaaaggcttttcaacaacgcacccgctattgaataaagaagttcaggctttaaaaaactggttgagtatccgtacttcgtacccgcatgctgagagcgagtgggtatttttatcacgtaaggggaatccgctttctcggcaacagttttaccatattatctcgacttccggtggtaatgccgggttgtcactggagattcatccgcacatgttacgccattcgtgtggttttgctttggcgaatatgggaatagatacgcgacttatccaggattatcttgggcatcgcaatattcgtcatactgtctggtataccgccagcaatgcagggcgtttttacggcatctgggatagagccagaggacgacagcgtcacgctgttttatagagatagttgagataccagggatggtgttaaaaactacattattcttacgatatatcaaaaatgattaaccatttattaattgatgttattgtaagtgtgattcttaattatcataataaacattaagttaaccatatccatacaaaatacaatggtttatgttcttcaaaataaataaacaaaatcattcataaatttacacatcacttaaaatctcctgtttccgcacttttttctttattttttaagcaactggaagttaatccactgcaatctattgttatattgaatcaaatcaatgaaaatagatgttgtcacatcagtgatattttatttttgtatgatatttaatgtaattgactgatagccacatcactccgtgtgtggttatctttttatctattgggctaattttgaccgattgaggtttcctataggtattcattcaaatatatctcagttaggagtactactattgtgagtaaacgtcgttatcttaccggtaaagaagttcaggccatgatgcaggcggtttgttacggggcaacgggagccagagattattgtcttattctgttggcatatcggcatgggatgcgtattagtgaactgcttgatctgcattatcaggaccttgaccttaatgaaggtagaataaatattcgccgactgaagaacggattttctaccgttcacccgttacgttttgatgagcgtgaagccgtggaacgctggacccaggaacgtgctaactggaaaggcgctgaccggactgacgctatatttatttctcgccgcgggagtcggctttctcgccagcaggcctatcgcattattcgcgatgccggtattgaagctggaaccgtaacgcagactcatcctcatatgttaaggcatgcttgcggttatgaattggcggagcgtggtgcagatactcgtttaattcaggattatctcgggcatcgaaatattcgccatactgtgcgttataccgccagtaatgctgctcgttttgccggattatgggaaagaaataatctcataaacgaaaaattaaaaagagaagaggtttgatttaacttattgataataaagttaaaaaaacaaataaatacaagacaattggggccaaactgtccatatcataaataagttacgtattttttctcaagcataaaaatattaaaaaacgacaaaaagcatctaactgtttgatatgtaaattatttctattgtaaattaatttcacatcacctccgctatatgtaaagctaacgtttctgtggctcgacgcatcttcctcattcttctctccaaaaaccacctcatgcaatataaacatctataaataaagataacaatagaatattaagccaacaaataaactgaaaaagtttgtccgcgatgctttcctctatgagtcaaaatggccccaaatgtttcatcttttgggggaaaactgtgcagtgttggcagtcaaactcgtttacaaaacaaagtgtacagaacgactgcccatgtcgatttagaaatagttttttgaaaggaaagcagcatgaaaattaaaactctggcaatcgttgttctgtcggctctgtccctcagttctacagcggctctggccgctgccacgacggttaatggtgggaccgttcactttaaaggggaagttgttaacgccgcttgcgcagttgatgcaggctctgttgatcaaaccgttcagttaggacaggttcgtaccgcatcgctggcacaggaaggagcaaccagttctgctgtcggttttaacattcagctgaatgattgcgataccaatgttgcatctaaagccgctgttgcctttttaggtacggcgattgatgcgggtcataccaacgttctggctctgcagagttcagctgcgggtagcgcaacaaacgttggtgtgcagatcctggacagaacgggtgctgcgctgacgctggatggtgcgacatttagttcagaaacaaccctgaataacggaaccaataccattccgttccaggcgcgttattttgcaaccggggccgcaaccccgggtgctgctaatgcggatgcgaccttcaaggttcagtatcaataacctacccaggttcagggacgtcattacgggcagggatgcccacccttgtgcgataaaaataacgatgaaaaggaagagattatttctattagcgtcgttgctgccaatgtttgctctggccggaaataaatggaataccacgttgcccggcggaaatatgcaatttcagggcgtcattattgcggaaacttgccggattgaagccggtgataaacaaatgacggtcaatatggggcaaatcagcagtaaccggtttcatgcggttggggaagatagcgcaccggtgccttttgttattcatttacgggaatgtagcacggtggtgagtgaacgtgtaggtgtggcgtttcacggtgtcgcggatggtaaaaatccggatgtgctttccgtgggagaggggccagggatagccaccaatattggcgtagcgttgtttgatgatgaaggaaacctcgtaccgattaatcgtcctccagcaaactggaaacggctttattcaggctctacttcgctacatttcatcgccaaatatcgtgctaccgggcgtcgggttactggcggcatcgccaatgcccaggcctggttctctttaacctatcagtaattgttcagcagataatgtgataacaggaacaggacagtgagtaataaaaacgtcaatgtaaggaaatcgcaggaaataacattctgcttgctggcaggtatcctgatgttcatggcaatgatggttgccggacgcgctgaagcgggagtggccttaggtgcgactcgcgtaatttatccggcagggcaaaaacaagagcaacttgccgtgacaaataatgatgaaaatagtacctatttaattcaatcatgggtggaaaatgccgatggtgtaaaggatggtcgttttatcgtgacgcctcctctgtttgcgatgaagggaaaaaaagagaataccttacgtattcttgatgcaacaaataaccaattgccacaggaccgggaaagtttattctggatgaacgttaaagcgattccgtcaatggataaatcaaaattgactgagaatacgctacagctcgcaattatcagccgcattaaactgtactatcgcccggctaaattagcgttgccacccgatcaggccgcagaaaaattaagatttcgtcgtagcgcgaattctctgacgctgattaacccgacaccctattacctgacggtaacagagttgaatgccggaacccgggttcttgaaaatgcattggtgcctccaatgggcgaaagcacggttaaattgccttctgatgcaggaagcaatattacttaccgaacaataaatgattatggcgcacttacccccaaaatgacgggcgtaatggaataacgcagggggaatttttcgcctgaataaaaagaattgactgccgggtgattttaagccggaggaataatgtcatatctgaatttaagactttaccagcgaaacacacaatgcttgcatattcgtaagcatcgtttggctggtttttttgtccgactcgttgtcgcctgtgcttttgccgcacaggcacctttgtcatctgccgacctctattttaatccgcgctttttagcggatgatccccaggctgtggccgatttatcgcgttttgaaaatgggcaagaattaccgccagggacgtatcgcgtcgatatctatttgaataatggttatatggcaacgcgtgatgtcacatttaatacgggcgacagtgaacaagggattgttccctgcctgacacgcgcgcaactcgccagtatggggctgaatacggcttctgtcgccggtatgaatctgctggcggatgatgcctgtgtgccattaaccacaatggtccaggacgctactgcgcatctggatgttggtcagcagcgactgaacctgacgatccctcaggcatttatgagtaatcgcgcgcgtggttatattcctcctgagttatgggatcccggtattaatgccggattgctcaattataatttcagcggaaatagtgtacagaatcggattgggggtaacagccattatgcatatttaaacctacagagtgggttaaatattggtgcgtggcgtttacgcgacaataccacctggagttataacagtagcgacagatcatcaggtagcaaaaataaatggcagcatatcaatacctggcttgagcgagacataataccgttacgttcccggctgacgctgggtgatggttatactcagggcgatattttcgatggtattaactttcgcggcgcacaattggcctcagatgacaatatgttacccgatagtcaaagaggatttgccccggtgatccacggtattgctcgtggtactgcacaggtcactattaaacaaaatgggtatgacatttataatagtacggtgccaccggggccttttaccatcaacgatatctatgccgcaggtaatagtggtgacttgcaggtaacgatcaaagaggctgacggcagcacgcagatttttaccgtaccctattcgtcagtcccgcttttgcaacgtgaagggcatactcgttattccattacggcaggagaataccgtagtggaaatgcgcagcaggaaaaaacccgctttttccagagtacattactccacggccttccggctggctggacaatatatggtggaacgcaactggcggatcgttatcgtgcttttaatttcggtatcgggaaaaacatgggggcactgggcgctctgtctgtggatatgacgcaggctaattccacacttcccgatgacagtcagcatgacggacaatcggtgcgttttctctataacaaatcgctcaatgaatcaggcacgaatattcagttagtgggttaccgttattcgaccagcggatattttaatttcgctgatacaacatacagtcgaatgaatggctacaacatcgaaacacaggacggagttattcaggttaagccgaaattcaccgactattacaacctcgcttataacaaacgcgggaaattacaactcaccgttactcagcaactcgggcgcacatcaacactgtatttgagtggtagccatcaaacttattggggaacgagtaatgtcgatgagcaattccaggctggattaaatactgcgttcgaagatatcaactggacgctcagctatagcctgacgaaaaacgcctggcaaaaaggacgggatcagatgttagcgcttaacgtcaatattcctttcagccactggctgcgttctgacagtaaatctcagtggcgacatgccagtgccagctacagcatgtcacacgatctcaacggtcggatgaccaatctggctggtgtatacggtacgttgctggaagacaacaacctcagctatagcgtgcaaaccggctatgccgggggaggcgatggaaatagcggaagtacaggctacgccacgctgaattatcgcggtggttacggcaatgccaatatcggttacagccatagcgatgatattaagcagctctattacggagtcagcggtggggtactggctcatgccaatggcgtaacgctggggcagccgttaaacgatacggtggtgcttgttaaagcgcctggcgcaaaagatgcaaaagtcgaaaaccagacgggggtgcgtaccgactggcgtggttatgccgtgctgccttatgccactgaatatcgggaaaatagagtggcgctggataccaataccctggctgataacgtcgatttagataacgcggttgctaacgttgttcccactcgtggggcgatcgtgcgagcagagtttaaagcgcgcgttgggataaaactgctcatgacgctgacccacaataataagccgctgccgtttggggcgatggtgacatcagagagtagccagagtagcggcattgttgcggataatggtcaggtttacctcagcggaatgcctttagcgggaaaagttcaggtgaaatggggagaagaggaaaatgctcactgtgtcgccaattatcaactgccaccagagagtcagcagcagttattaacccagctatcagctgaatgtcgttaagggggcgtgatgagaaacaaacctttttatcttctgtgcgcttttttgtggctggcggtgagtcacgctttggctgcggatagcacgattactatccgcggctatgtcagggataacggctgtagtgtggccgctgaatcaaccaattttactgttgatctgatggaaaacgcggcgaagcaatttaacaacattggcgcgacgactcctgttgttccatttcgtattttgctgtcaccctgtggtaatgccgtttctgccgtaaaggttgggtttactggcgttgcagatagccacaatgccaacctgcttgcacttgaaaatacggtgtcagcggcttcgggactgggaatacagcttctgaatgagcagcaaaatcaaataccccttaatgctccatcgtccgcgctttcgtggacgaccctgacgccgggtaaaccaaatacgctgaatttttacgcccggctaatggcgacacaggtgcctgtcactgcggggcatatcaatgccacggctaccttcactcttgaatatcagtaactggagatgctcatgaaatggtgcaaacgtgggtatgtattggcggcaatattggcgctcgcaagtgcgacgatacaggcagccgatgtcaccatcacggtgaacggtaaggtcgtcgccaaaccgtgtacggtttccaccaccaatgccacggttgatctcggcgatctttattctttcagtcttatgtctgccggggcggcatcggcctggcatgatgttgcgcttgagttgactaattgtccggtgggaacgtcgagggtcactgccagcttcagcggggcagccgacagtaccggatattataaaaaccaggggaccgcgcaaaacatccagttagagctacaggatgacagtggcaacacattgaatactggcgcaaccaaaacagttcaggtggatgattcctcacaatcagcgcacttcccgttacaggtcagagcattgacagtaaatggcggagccactcagggaaccattcaggcagtgattagcatcacctatacctacagctgaacccgaagagatgattgtaatgaaacgagttattaccctgtttgctgtactgctgatgggctggtcggtaaatgcctggtcattcgcctgtaaaaccgccaatggtaccgctatccctattggcggtggcagcgccaatgtttatgtaaaccttgcgcccgtcgtgaatgtggggcaaaacctggtcgtggatctttcgacgcaaatcttttgccataacgattatccggaaaccattacagactatgtcacactgcaacgaggctcggcttatggcggcgtgttatctaatttttccgggaccgtaaaatatagtggcagtagctatccatttcctaccaccagcgaaacgccgcgcgttgtttataattcgagaacggataagccgtggccggtggcgctttatttgacgcctgtgagcagtgcgggcggggtggcgattaaagctggctcattaattgccgtgcttattttgcgacagaccaacaactataacagcgatgatttccagtttgtgtggaatatttacgccaataatgatgtggtggtgcctactggcggctgcgatgtttctgctcgtgatgtcaccgttactctgccggactaccctggttcagtgccaattcctcttaccgtttattgtgcgaaaagccaaaacctggggtattacctctccggcacaaccgcagatgcgggcaactcgattttcaccaataccgcgtcgttttcacctgcacagggcgtcggcgtacagttgacgcgcaacggtacgattattccagcgaataacacggtatcgttaggagcagtagggacttcggcggtgagtctgggattaacggcaaattatgcacgtaccggagggcaggtgactgcagggaatgtgcaatcgattattggcgtgacttttgtttatcaataaagaaatcacaggacattgctaatgctggtacgcaatattacctgaagctaaaaacctgcacgttagccctttgtaggccagataagacgcgtcagcgtcgcatctggcataaacaaagcgcactttgctggtctgttcccctcaccctaaccctctccccggaggggcgaggggactgtccgggcacatttttagactttgtcatcagtctgagcctgccattggcaggctctggtgtccttttacgctaccatgctaataatcagcacaataatcagcccaaccacggagttgaccagctccagcagaccccaggttttcaacgtgtcttttactgacaggtcaaagtaacctttgaacaaccagaaagatgcatcgttaatgtgggtgagggtgttggaacccgcagccgtcgccagtaccagcagcgccggattcacgccaaccagctgaccagttgctggatctaggattgcagcactgataatcccggcggcggtcatcgccgaaacgacaccctgacccgtcgccagacgaattagcacagtgatcagccatgccatgatgtagggcgagatattgccgtgggacatcaacatgccgatggtgtcgccaatgccggtgtcgatgatggtctgcttcagcacgccacccgcaccgatgatcagaatcaccattgcaatactcttcaccgcgctttcaaaagcgttcatcacccactgcatgtcatgaccacgtgcggtgccaaagagtacgaatgcaaccaccatcgcaataaacattgcaatcggcgaggaaccgataaagttaaccacttcccaggcaggggtatcttttaccagccagatattggcgatggtggtagagatcataatgatcgccgggatcagcggcaccagaatcgaaacgccgaaagagggcagattattcatatctaccggttgatctgctttcaggaatgatggcgttgggcgctcaagattgccgaggaacttcggcaggatcagacctgcgcagattacacttgggatcgtcaccagtacgccatagatataaaccatccccatatccgcgccataagcattcaccagcgccaccggacccggctgcggtgggaacagtgaatgtgcggtagtggcagctgctactgccgggatcgccagtttcaggaacggaattttagcttcggcggcaataacaataaccagcggcgctaacatgataaaggccacttcatagaacatcgccagaccaaaaatcaggccgatgataatcaccgacagctgtacatagcgcagaccgagacgcgccagcagcgtatgcgctatctggtgagccgcgccggagtcgaccatcaatttaccgatgaccgcaccgaacaccacgatgatagccagttcccccagcgtgttgccgaagcccgctttcatagtgtgcagcagcgacatcaaatccatgcccgccagcatcccgacggacagcgccgccaccaacaaagccaccattgaattgattttgaacttcaaattcagtaccagcatcagaccaatgccgaataccacccagagaatgttaagcacatgcataacgttttaccttacctggttgaaccgttgttattttgggcgatatgttatgtaaattggtcaaccattgttgcgatgaatgtcacatcctctgatcaataaccatcgattaccctttgctgcaatttgcagcaacaaccatgagagtgaaattcttgtgatgtggttaaccaatttcagaattcgggttgacatgtcttaccaaaaggtagaacttatacgccatctcatccgatgcaacgccacggctgcggtctggttgttcatccggatacctaaacaactccagggttccgcgtctctttgctgtggaacccactatgtgaaagaggaaaaatcatggaacagacctggcgctggtacggcccaaacgatccggtttctttagctgatgtccgtcaggcgggcgcaactggcgtggttaccgcgctgcaccatatcccgaacggcgaagtatggtccgttgaagagatcctcaaacgcaaggcgatcattgaagacgcaggcctggtgtggtctgtcgtagaaagcgtgccaattcacgaagatatcaaaacccacactggcaactatgagcagtggatcgctaactatcagcagactctgcgcaacctggcgcagtgtggcattcgcaccgtgtgctacaacttcatgccggtgctcgactggacccgtactgacctcgaatacgtgctgccagacggctccaaagctctgcgcttcgaccagatcgaattcgctgcattcgaaatgcatatcctgaaacgcccaggcgcggaagcggattacaccgaagaagaaattgctcaggcagctgaacgcttcgccactatgagcgatgaagacaaagcgcgtctgacccgtaacatcattgctggtcttccgggcgcggaagaaggctacaccctcgaccagttccgtaaacacctggagctgtacaaagatatcgacaaagcgaagctgcgcgaaaactttgccgtcttcctgaaagcgattattccagttgctgaagaagtcggcgtgcgtatggctgttcacccggacgatccgccgcgcccgatcctcggcctgccgcgcattgtttccaccattgaagatatgcagtggatggttgataccgtaaacagcatggcaaacggttttaccatgtgcaccggttcctacggcgtgcgtgctgacaacgatctggttgatatgatcaagcagttcggtccgcgtatttacttcacccatctgcgctccaccatgcgtgaagataacccgaaaaccttccacgaagcggcgcacctgaacggtgacgttgatatgtacgaagtggtgaaagcgattgttgaagaagaacaccgtcgtaaagcggaaggcaaagaagacctgatcccgatgcgtccggaccacggtcatcagatgctggacgacctgaagaagaaaaccaacccaggttactccgcaattggtcgtctgaaaggcctggccgaagttcgcggtgtcgaactggcgatccagcgcgctttctttagccgttaatatccaccggcatggctgcgcgccgtgccggttccttcttccttgccgtcactctttgaagacggattctggagtttacgatgactactattgttgacagcaatctgccggttgcccgcccgtcatgggatcattctcgtctggaatcacgcattgtgcatctcggttgcggggcgtttcaccgcgcgcaccaggcgctgtatacccatcatctgctggaaagcaccgacagcgactggggcatctgcgaagttaacctgatgccaggcaacgaccgcgtgctgatcgaaaacctgaaaaaacagcaactgctgtacaccgtagcggaaaaaggcgcagagagcaccgagctgaaaattatcggttcgatgaaagaagcgctgcatccggaaatcgatggctgcgaaggtattctcaacgcgatggcgcgtccgcaaacggcgattgtctctctaacggtcacggaaaaaggctactgcgctgatgcggcaagcggtcaactggatctcaataacccgctgatcaagcacgatctggaaaacccgactgcgccgaagtccgcgattggttacatcgtcgaagcgttgcgtctgcgtcgtgaaaaagggttgaaagcgtttacggtgatgtcctgcgataacgtgcgtgaaaacggtcatgtggcgaaggtcgcggtactggggctggctcaggcgcgtgacccgcagctggcggcatggattgaagaaaatgtcaccttcccgtgcaccatggttgaccgcatcgttccggcggcgacgccagaaaccttacaggaaattgctgaccagctgggtgtttacgacccgtgcgccattgcctgcgaaccgttccgtcagtgggtgattgaagataacttcgttaatggtcgcccggattgggataaagtgggcgcacagttcgttgcagacgttgtgccgttcgaaatgatgaagctgcgtatgctgaacggcagccactcttttctggcgtacctcggttacctcggcggctatgaaaccattgccgacaccgtgactaacccggcttatcgcaaagcggcctttgccctgatgatgcaggaacaagcgccaacgctgtcgatgccggaaggtacagacctgaacgcctatgcgacgctgctgatcgagcgtttcagcaacccgtctctgcgtcaccgtacctggcagattgcgatggacggcagccagaagttaccgcagcgtctgctggacccggtgcgtctgcacctgcaaaacggcggcagctggcgtcacctggcgctgggcgtggctggctggatgcgttacacccagggcgtggatgagcagggtaatgccattgacgtggtcgacccgatgctggcggagttccagaagatcaacgcgcagtatcagggcgcagaccgcgtgaaagcgctgctgggcctgagcggtatttttgccgatgatctgccgcagaatgccgactttgttggcgcagtgacggcggcatatcagcagctgtgcgaacgcggtgcgcgcgagtgtgtggctgcgctgtaactaactgattaccctacagacttactggtcaatcaaactgatatttggttgaccagttttcgtttttttgcccacctgtacgtgccaacttccagtgctaatggtatagtttgagattaacgggggccgtaaaattgcccgttgtaggccggataaggcgttcacgccgcatccggcaaaaatttgattaaccgcacctaacggacacaacaccatgaaatctgccacctctgcgcaaagaccttaccaggaagtcggggcgatgatccgcgatctgatcataaagacgccgtacaatcctggcgaacggctgccgccggagcgtgaaattgcagaaatgcttgatgtcacgcggacggtggtacgtgaagcgctgatcatgctggagatcaaagggctggtggaagtacgccggggtgccggtatctatgttcttgataactcaggcagccagaacacagacagtccggatgccaacgtctgcaacgatgccggtccttttgagctgttacaggcgcggcagttattggagagcaacatcgccgagtttgccgctttgcaggctacccgcgaagatatcgtcaaaatgcgtcaggcattgcaactggaagagcgtgaactggcttccagtgcgccgggcagcagcgaaagcggtgacatgcagttccatctcgctattgccgaagcaacgcataacagcatgctggtggagctgttccgtcagtcctggcagtggcgggaaaacaatccaatgtggatccagttgcacagccatctggatgacagcctgtatcgcaaagagtggttgggcgatcacaaacagatcctcgccgcgttaatcaaaaaagatgcccgagcggcgaagctggcaatgtggcagcatctggaaaacgttaagcaacgtctgctggaattctcgaacgttgacgatatttattttgatggctatctgtttgattcatggccgctggataaagtcgacgcctgacttattataataagcgcaagggtaaacgttccttgcgctttcttaaattaagaagtcgcaatgagtattactttgtaaattgcagggtattgtttagctatctgtataacctgaatgttagtactcattcttcctggtagttatttaccaatataattccattcaccattttttaattcaaacagttctggaagagatgacggttgcagagtcatacgtttgagtggtgcattttcatcacccgggataactttatatcccatttttgcatggatctccgcggtaccgggataggcttctataccaattattgggtcattacccaactcaatattagcattaagtaatgcggcaagggcgaatccggaagaatttgctacccctgttaccgtcattatctgatcaatatagatatcaatccttggctgctcattggtccatctttttgcctgagaagctggaagggttgaaatatatcctatcgtggttccggcataaccaggaacattgcaaccagggcctaatgttatttcatgaactgtatagtcctcaacaggatcgaaagggctcttcataaataaatttagccgtaaaccttctgctaactctgtggtagcatgcgcctttttacatatgccaccatatatttcgtctaaagctgaggtgattttcaagttccgatagagcatacgtcctgttgttgtaataccatcggattctctgcatgctcctgtcacataattaaatggccaaggctctttactaatatcaagttttctaatttcgacaacgctttttccatcgtaattatggttattgccacgagtaagaggcggaagatagatgttttccgaatccatgcgtgcatattttaatttacgtgtaaactcactgtcgactattgggtgatgaaggaagtgagcatctgtaataatttgactctgaagggcattgcttaatggcatagacataatagttaccttttatgagtatttcactgatgtttagaaaaatagataaatttttctgtagtaaaaagagaagtaaacaaatgacatgcatgtttctgttgtagtgatatcaactctacacggtgatattaaagggtaggaaacactctaaagtatcaaaaaacgctcatttaaaattatttgcatgcaatttaaaagcatatcttattactaattggaatttgatgttgctatattgaggtctatattaataatgcctgtgaatggtatttttgatgtatttgatatgttatcaatttatattatttacaaactaattgtttcaaataatacatggctgattatgcggaaataaataatttcccaccggaattaagtagcagcggtgacaagtattttcatctacgtaactattcggaatattcagaatatactagcggtttttttttgagtttgatgatttttatcaaatcatgacttttttcctgaaaagtcagtagatattcataggcaagtaaggttttatactttgctgacaggattcaggcctgtctcagactgacatggatgtaatgaacaaaagggaatggctatggaaaatgagcatcaatacagtggtgcccggtgttcagggcaagccgcatatgttgctaaacgtcaggagtgcgcaaaatgatgcgacaatcacttcaggctgttttacctgaaatttcaggcaataaaacgtcatcgctgcgtaaatcggtatgcagcgatctcctcactctttttaattctcctcattcggcattaccgtcattacttgtttcaggcatgcccgagtggcaagtgcataacccgagcgacaaacatctccagagctggtattgccgtcagctgcgttctgcactgttatttcatgagccacggattgcggcgttgcaggttaatttgaaagaagcgtactgccacactctggcgatcagccttgagataatgctgtaccacgacgatgaaccgctaacgtttgatctggtctgggataatggcggttggcgcagtgcgacgctggagaatgtcagctaagcacaatctccagctcgcgcagttcacgccagaagcgttcggcaacgggattcatgcgggtattcatccggtatgcataggcctgaatcgggatcaccagttcgtcccgattcagtacaacgagcttcccgctgcgaatttcttgttggatggcgtactccggcagccaggcaatcccacagccgtcgagggcaacctgctttaaaagctcgctcatcgaagagacaaaaaaggtgctgaaacttaactcactgtggcgcgtcagggtgcgattaatcaatcgccccatgtaggagttgcggctgtaattcagtaacggaaagtgtggctgcgcgaggttaaaaagtgcttctccgtgttcgtcactggcgcagacagggaacaattgagattcaaataagcgaatgtggtcaaacggcgcttccagcaaatcttcgtcgtgaaaggaaaaaatacagtcactttgcccttcacgcagtttatcgaccgcttcatcgacatcaatagcttcaattgcccaggtaaagagcggcggcatctggctgataatggacggtaacagcccgagggaaagagagtgtgcagcggctatcttgatttttcgttgcgcgtaatcgctgccgccacgcagctctgccagattgctctctaactgttgcaacagatggcggatctgcgaatggaagattttcccttgttctgagagttgcagcggcgttacctggcggttaaacaattcaacaccaatcgcctgttccagcgcacggatgcggcggctgaatgccggttgcgagacgttgcgactgactgccgcctgggaaaaattgcggcatttttccagggtcagaaaatcataaagccatttggtttcaatattatgcaaaatcgcaccacagtcatccattacgttttactctgtcagccgcccttgcgggcattctacgtccattcgggcggctgacaaccgtttaagccgtttcaaacgttcctttcacgcaggctttgccgtctttgaccatcagtttgccgcgagcgtatacctgctcaatgcgcagttctggcgtcatgaccagcaagtcagcatcattgcctggcagaatttcgcctttcccggtcaggttaaggaaaccggctacgctactggtgagcgggcgcagggcatcgctgatactgaaatcatagtctttgaccagcacctgcacggtttccagcaacgtttcaaaaccggcaacaccgatatgggttaaattcccttcgtcatcgaagaacggctggctaccgttgccgtcggagctgagggtgacgcgtgccagcggaatacccgcctgaacggcgcgggcaataccttcggcaggggcgaccggttcgtcaatgctgctggtgatatcgatggtgccgcctttgcgcgcgaactccagcgcctgctcaaacaacggtacgttgcggttaacgtgggtcggcagcagcttgctgatcggcacatcgcagttttccagcaggtcataaataggctgtaacgcctttttactgtcgcccatgtggaacacggtgacgccaggtttaccgccgagcaaaccgccaacgcgggattctgccgccatattggccaggtgataaacgtccggtgcggcagaacggtgatcagagatggcgcatttcacgccaatcacacgatcgataatcgccacgtctttttccacggaacccgtaatggtgcgggaagggacatgataagcgccggtcagcatccaggcgctgatgccttcttcattgagcgcacgggtcttggcgagcagggattccgggtggcgagagatagagtcggtgcccagcagaccaaccactgacgtgacgcccgcttccgtcaggcgacttagcgccacttccggcgtgcgcgtcgtgggacctgcttcgccgccaccgccaatcaaatggacgtgttgatcaataaaacctgggcagaggatctgcccactgagatcgacaaccgtgcagttcggtacaatgtcagaagggatattgctggcaacggcgataattttgccgttagcgacgaggacatcgcaaattccccgatcttccggcgcatacaaatgcgctccctgcagcagggtaaaaccggctgcggtataatcaatcatggtaactccttgttaaacaataagctgcataacccagatcgacagcaatgcgttaatcacgcagaccgtaatgatatgcgggtaatatttggcattcacttcggctgtccccaggcagcgaccgacattttgcaccgggttgcccattaaatacatcgcgggcagtaaaacggtgacatcgtgaccggttaatgcgccagcggttgccagactggcggcaacaccgactgcgccacccatactcattaatgcggctaaaaggacggttgccgcttcaccgggtaatccccacagcgccattacgggttcacagatatgccccacccagtcgagcaggccggtaattttcagcgcctgaatgatgacaaacgccatcaccacgtttggcagcaggttggtcgtggcgatagtaaagccacggcgcgcgccatcgataaacatatccatgacgtttttgcggacctgagttgtcatgcttgcgctccttgcgttgggttgcgacgttcttcgaagttaagccagacgcgcaaaatgttggctccgacaaatttaaacaccaggatgacggctaaaggtacgattacggacgtgcccagaaaggcaaacaccgcgacgccggaagagaagtagttggtgatgatggcgctaccgctggtttgatatgcggcgaaaatcactttatcgcgttcggtaatttcaccttcctgcgccagctctttggtcataccggcggcggcatcggtgttttgcaggttagcgatcagcgccagcgagcagatccctggaatgcccaacaacggttttagcacaggtgtcattaactgctgcgcggcgcgtaatccaccaagaccatcggtaattgaaataatccccagagagagaatgactgacggtgccagctccagcgcaaagagaaagccatctttagcccccgcgccacccgcgccgcgaaatgaggtggtggctccgttcgcaccaggcagttgcccaaacgatccgttcagaacggaaaaatcaaaaacgcgccaccagctgtctgttccggaaaaaacaccggaaaaaaagattatggtgagaaaaaaggccagataccctttaatgcccactttttctgtcgccagctccccggctacagcatccccttgttgtgtcataacaatccccattgtttttttgtgtttgtgtgttgcttgagccaggaaaattcctggaactgaaaaaccttatcagccatgtgggtatggggaaaatgcaagtatgtttctggctatgcgttttttgcatagcggaaaaattacgctgtgtggaaaaggctctgcgcaggattgagttgcagaaaattcataaaccaagtgacaatgacatcagtaaataaaaacagaaaatccagggacgaaaacgagatggcaaagtacaacgaaaaagagctggcggatacgagcaagtttttaagttttgtcctccgacacaaaccggaggcgattggtatcgtactggaccgtgaaggatgggcggatatcgataagctcatactttgtgcccaaaaagcgggcaagcggttaacccgtgcattgctggatactgtggttgccaccagcgataaaaagcgttttagttattccagtgatggtaggtgcatccgcgcggttcaggggcattcgacttcgcaggtcgctatttcctttgccgaaaaaacaccgccacagtttctctaccacggtacggcaagccgtttccttgacgagataaaaaaacaggggctgattgcaggtgagcgtcactacgtacatctctctgctgatgaagcaacggcacgcaaagtgggagcaagacacggatcgccggttattttaaccgtcaaagcacaggaaatggcgaaacgaggcctccctttctggcaagcggaaaacggggtctggctgacatcaacggttgcggttgagtttcttgagtggtaagggaaacttccctcatgaagtgaccacttgtagcttaaataattgcactgtgctgataagcgcagcaataaacaacgccgccgcgccgcagagagtggcgctggcaagcgccgatgttccattgctgagcatactggtcagcgccgggccgaggatttgcccaatgccgtaaatgagcgtcacaaagcctaaaagattgagatttcccggtacgctcagttggcgggcgatagtcatcaccagagatgtcgtgcccataaaggtaccgccaaaaccaagactgctgatgataagcaagagaggcgagtcgctggcgagagtaagcagcacacagatagcctgcaccagcaaattcgccgtcaggcagggcaaagccccccaacgttttgctgcccatagccagccaaagcaaccaggcacaattgataagccgactaacgtccagagatgggcggttaacaatggtgagcctgcatctttcgccatgagcggcaggtaagtcgcgacgatgatataaccaaatcccgccaggccgtacagaatagccagtaaccaccagctcattatctgttgctccgtttttgccaatggcattggtgtgatggcgtgttttttcgagggcattaaaagcgtaagtgcaatcagcatcatgccagaaagcgccccggcgccttgccataacgtttgcgaggagaggtcaaaatgcaggcctgccagaacatattcattgcccagtgcgatgccaatgccaacgccagaaaacaaagctgccagcacaaaaggatggcgcgtgtgctgcataatcagcgtcgaaccaaaaatcagcataccggcgctggcgacacccgccaggacgcgaatcaataacaccagaataaatggcggcaaccatgccattgcgaggatcaacaacccgctcgccagggcagaagccaacagaaatgggcgcaggcgcgatggctggtgaaatgcgccaaaagaaaatagcagactgccagccagataccccgcatagttgccgctggcaatccacgagagctggctaaatgaaaacgatccttccgccatcatgacgggcaacataggcgtataaaggaagcggcctaaacccatacctaaggtcagaaccagcatcccgaaaagcgcggtgctgaaagaaaagcgttctacgggatgcgtggacgaaggcatgtttaaccttgtttgtcatttttgttgttaacaagttaataacaaaaaggtgaagcatgccagcctgttaatgcgatgattgaggggtaaagcgataaaaacgatttggttcgctaacgatataaatattaccagaggcatccatcgcaaccccttcggcctgtttgatgttatgcgacaaacctcgactgcctttggttagtgacatttcaccgataacctcgccaaccagggttacttcctggagtgcgcgagattcatgagacagcaccagaagcgtatttttttgctggttaaattctgcgccggacacatcatctaaagtaaattgccgttgtagtgcctcgtctttgctgatgtgtaattcattgctacttaacagcccgttaactttgtagacctcaatcggatttttctctttaaaaaaccagaaagtgtgatcctggcgagaataagccaacccttcaaaaccgcaattggttggggagtcttgcagcgggatttttatttttttgaggatttttacttccgagtttggggtcagtgaaatcacataaatggcgtaatcgcgctcatcgctaatgacaaactgattatcgccaatgtattcgatcgtctcgagatccttaacaaaatccagaggaattgtgcggataaaatcaccattggtggtcatttcaacaatggcggcaggtttgttgatagtgctaaaaagagtattgctttgtgccgaccaggtcagcgaagagatattattcgttatgcctgcaatttctttgccgtcaatggtggcgtggtaattctgaaatgatgctgcatgattgcttttacgggcgcaagattgcacgaagaaagtacacactgccacaatggcaaaaagaatcacaataatggagatgcgtttacttaacgaaatactttttgtcacggtaatccctttaaggcaaatcaataagatatcgagaagtatacgtagcgaccttaatgaatccttaacgcggagaaaccccgtaatgtgcaatgcagcgccagacaccatcctgctggcaataaattgactcagtcagcccagggatcacccattgtatttcctcgccggggggacaggtcagccaaatgcataacccgcagccgccgcgtaaatcacggggaatatcgctgacgcgaaaagtcatgcccgctgcctgcaacgctttgcgggtttgtatgacgccgaccgtggagtgaaataaaaataaaaactctttcatcggcgtgtcctcactcgttgaccaattaccgccgcgccaattgcgccagcaaattgcgcatcaggatgggtatttaccggcattcgcaggtgagattccagcatccgggcaaacttctggcaatgactaacgccaccagtaaacagaatcggcgcttcacaggagagacgagcaatgaaattggcactcctccgcgccatcgcgttaatcactcctgcgagaatcgcttctggcgcgacgcccgctgagcgcaggctgatcgcttctgattcagcaaacactgtgcacatactcgtgatggcgtgcggcgtgacattttcggtaatgctgtcgagttgctcgacgctggtgccaagcgtgcgcgagatcacctccaggaaacgcccggtgcccgccgcgcatttgtcattcatcaggaaatcgcacaggttaccgtcatcatcaagctgaatcactttgctgtcctgaccaccgatgtcgattaccgcgcgcgttgctggcgcaagaaaccgtgcgcccagcccgtgacaggagatttccgttacctgtttatcggcaaaatccaccagttgccgcccgtagccggtgagcgtcagaaacggcgttgtctctaacccttcgcgcagagtttcccaggcttcagtaattgctgttgccgggcgaaagggggttggaacgaggaaacggcgcgtaatcacgccgtctgccagtaagatccctttggtggcggttgagccggaatcaatgccaatcgaatatgccactgccactccttacagcatctcaataaaggccgcgacacgggtactgagctgcccgacatccgaggtggagtagtctgtttcaatagcgatataaggaatgttgtgctgctggcgcacatgacgtttaatcgccagcgattccaccgcgtaggtatggcacgcctgcaaaatcacatcaactacgccatcgacctgatattcctccaccatctggctgagcattttcaggcgctgatcgttcggcgaaacacaggagcagccaatcgccagatatttatccgccagcgcgtcgtagacatcgcccgtttctgccacgcattgctcggtcgctttcgccccggtgcagttttcataaccgacaacccagccgccattctcttcaatcgcgcgcaccactttttctgctgcgccgccaatcgggcagccggtgattaaaatgcgcggacgcgggtccagtcgctggccttcttcccactgctgacgaacgcgggcggtcattgcatccagttcattgatcaacgcctctttatcgaaccggaaggttgcgccgtaaaccactttcagaatgtcgctgccgctaagcgccggaggatttaactgcccaagatgataaaaattagccagtgcgcgacgttcgcggtttttcagcgcaatggcatcgcgcagagcatcttcgctaatctcgtgcccaaaacgttcttctaccgttttttgcaagcgcagcatctcggctttccataacgcacgcgaggcatcgtccttaacgctgttgggcaattgcatcacatgaacaggcttaaactccgccatgtattcatacattttctttttgccgtcgcaggtggtttcaccgaccaccagatccgaaaagtagaagtaggggcatttatcggttttgccgaagccgtagctgcttttaatcagcgggcagaggttgcgcggcagatctttctccgcttcttcaatggtttcatcagaggtggaacagagcgaaaccacaaccgcaccggctgccatcgggatctcttgcggcataaaggtgcagtaagtgccaaccagcggaatgccgcgctccttgagatccatgacggtgagaaagcctgtctggcgagcttcagagaactgatcgaaaatggcgggtagatcggtgacaagtgacatgattttccttccccgtaccacgggagataatgaaaagaggccacattattaccattcttttagtatggtttatttgatctctctcgcggttagccacttagtttttcatggatttctaaaaattgccgagggggaacaaggccgggagctgcgacagcaaatataaaattagcccaatacaaccgccaaccagcgtaccgttgacacgaataaactgcagatctttgccgatatttaactctatttgccgcgacatatcccgcgcatcccagctttttaccgtatcgctgatgtggcgcgtcaggaatgcggaaaactcaggcgcgacgcggtgcgcggcttgttcaagatgaccatttaacgacgcccgcaaggcatcatcggcaattaacgtttcgccaaaccattgacccgctcgtgcgatgcgttctttcacacgagaatcttcactgttgatatccactttcagccattcccgtaaatccccccacaattcactgagatagcgattaaaagcttcatcttctttcagatagctttttacggcatcggctcgcgctgccatttccggatcgtttttcagcttgtcgatcagggcgaaggtggcgcgatcaaacgcatggcggatctgatgcgcacgatcgcgactaatatcatcaagcaaagaattcaccgcgtcagaaaccaactccgcgctatgttcgcccaaccattcggtggggagaattttggctttcagtggatgctcgctctccagccagcgaacaatttgctgggcgataaacttgcgcgatttatcgcgctggagaagggcgatcaactgtgcgatcagcgtatccagcagcacctgatgacgatcgtttttggtcatactctccagcatcaacgcactggtgccggaaagatcgaccttatcaatcgcccgatggaccgcgcgcttaagcaggcgctgaatacgcgcatcatcggtaagttcgagaaaaccgctcatgatctgcaacagatgctgaccaacgcggcgggcgttttctggctggctaaaccagttgccaatcagcaacgccggttcgtggcgtcgaatcaatgccaccagggattgagtatcaagaaatttttcctgcacgaactggccgagattttcgccaatccggtctttattacgcgggataatcgccgtatggcgagaaatgatcggaatcggcacgcggcgaaacagcgccaccaccgcaaaccagtccgccagcgcgccgaccatcgccgcttcagcaatcgccttcacgccgctcacccaaaaattgggcggcaaaaacagcgtaacgacaaaggtagcagcggcgataagcagtaaagagagcgccaaccttttggcgcgtctgagttcgatgagtttattcataacgttaagaatagagcctgacggccggatcgcgcaaaaatcactgctcctccactagctcggctgcctgatgctggcgcacgcgattgagcaatcccgccagggtgaaaacgacgataacgcccgccacaacggctaacagatgaaacggcaagcgaccgccgttaaaccatagccagcggccgatttcgaccgagaccgacatcaccatcaggatcaccatatttagcgatgcggagacggtccctttcggtaacttattggaaaacagcgtaaagcggaataaggtcgggaaaatcaaaccaatcccgaaagcatacagactggtgcccagcaccgaccacagccagacgtgcggcgacagcagattgccgacaatcaacagcgagaggccgaccagttgaatgggtacggcacgccagataaaccgcggttcggtcggatctttaacaaaacgcgccacgatggcattcgcaacaatcaccgcgccgaacaccggaacctgtgtccaggcgaactgcgaagttgttaagctgcctgcatcgataaggatcaccggcgagacagccacccagctcatcatcgggatatagcttaaagagatggttgctgcgccaaagaggaacagccgattgcaaaagacattacgaaaatcgcgcaagacgcttttggcgctaaacggaaccgcgccgcgcttcaccgtctctggcatcgccaacagtaagccaacaaatgagataaaacccataaccgcaatgatggcaaaaaggactttccagtgcataaagtgcatcagagctgcgccggaaagcgggccgataatcggcgcaatcagtacgatggaggtgataatcgccatcaacttgatcccttttgtctgtccgaacgcctcctgcaccgtgacataaccaacggtggcaataaaacagatactggtgccctgaattgcacgcgcgataagaaactgtgtcatagacgttgtgaacattgtcgcggcgcaggcaagggtaaaaattagcgccccggtaatcagcaccggcctgcggccaattctgtcggaaagcggccccagcagccactgtaacgccataccgccagcaagatagagactgacggcagcaggggccagactgacatcggcattaaaatcacgtaccacattaatgatcccaggctggatcagatccgtcgacagatacgcagcaaagtcatacaaaatcaacgccatcgggaaaaacagcgtggcggcatggcgggtaaaaaaacgtggcataacaaacaactccttgtccggagaaccccaacggggaaaacgaaattcaataccgtcggtaatgacgaaaggcaggtgagaagggcaacgagactgcaaatgtactgaatttcatgtaatcaaccacactgcctgtgaacacacagacagagaaatactttctgacttcgggtcagaatgtataacgattacaaatagtcatcagcacattacacctcttgaattgatgggttgcatagaaaatatacaccttaagtgtaattaaaatttgcggttaatcaaaagagcgcggtggaaaggggaatatctgccgggtacaggacatgtaaaacgcgagcttgtttccggaaaaatgtatcgtttgcagaagaataaaaatagcctggaaagcgcctcggggaatgggaaattgccgggtgagaatggttttgttagtcgctaaagtcaggccatctttttcaacaggtgatggatcgccatgacaaacttcacgaccagcacgccgcatgatgcattatttaaaacctttctcacgcaccctgacactgcgcgggattttatggagattcacttacctaaagatttacgtgaactgtgcgatctcgatagcttaaaactggaatccgccagctttgtcgatgaaaaattgcgggcgctacactccgatattttatggtcggtaaagacccgcgaaggcgatggctatatctatgtggtgattgaacatcagagccgcgaggacattcatatggcctttcgcctgatgcgctattccatggcggtgatgtagcgccatatagagcatgataaacgccagccgctaccgttggtcatcccgatgctattttatcacggtagccgtagtccttacccctggtccctgtgctggctggacgaatttgccgacccgactaccgcacggaagctttataacgccgcgttcccgctggtggatgttactgtcgtgccagacgacgagattgtgcagcatcgcagagtcgccctgttggagttgatccaaaagcatattcgccagcgcgatctgatggggcttatcgatcaactggtagtattactggttacagagtgtgctaatgacagccagataactgcgctgttaaattacattttactgactggcgatgaagcgcgttttaatgagtttatcagtgaacttacccgtcgaatgccacaacacagggagcgaataatgacgattgcagagcgaattcataatgatggatatataaaaggggagcagcgcattcttcgattgttgttgcagaatggggcggatcctgaatggatacaaaagattaccggactttcggcagagcaaatgcaggcattaaggcagcccttgcctgagcgtgagcgctattcatggctcaagagctaatcagagacggatgacaaacgcaaagcagcctgatgcgctatgcttatcaggtctacataacccattaaatatattgaactttaaagatttttgtagacctggtcaggcgttcacatggcatccggcatgaacaaagcgtactttgcttaattcaggctggaacgtggcgatgacccagcaaagataaaacgagtcacaggttatgcatgagaggaaatcaggcgcttcgccgctatttcgaatttattccattgcccgatacacggcctcgccaatttgcttcagtgcttcgcgataggtttcgctgagcggcaaagcgcagttgatgcgcagacaattacggtatttgccggaagctgagaaaatcgagcctgccgccacctggattttcatgcggcacagctgccgcgcgacgcagaccatatcgacctgttcaggcaattctatccacagtaaaaatccgcctttcgggcgcgtaatacagatttcgcagggaaaatattcccgtatccagcaggtataaagcgccaaattgcgctgatagatctgccgcatccgccggatatggcgatgatagtgaccttccagcacaaacgttgccgccgccatttgcgtggacggcacattaaagctgctgatggcgtatttcatatgcatcagtttatcgtgataacgccccggtgcgacccaacccacgcgcaggcctggtgcaatacttttactgaacgagctgcacaacagcactcgcccgtcgatatcccaggaatgaatggtccgcgggcgcggatactccgtcgccagttcgccatagacatcatcttcaaaaatcacaatatcatgacgctgagcgagagagagaacggcccgtttgcgcgcgtccggcataataaatcccagcggattattacagtttggcaccagaatgatgcctttaatcggccactgttccagcgccagttccagcgcttcaacgctgatgccagtttctggatcggttgggatttcaatcactttcacgcccatgccgcgcagcatctgcatcgaaccgtaataacagggggattcgaccgcgacaatatcgcccggtttacacactgccattaacgccagcgacatcgagttatggcagccgctggtgatgatgatgtcatcggcggtgaccaccgagccgctgtcgagcatcaggcgggcaatctgctctcgcaatactcgctgaccggctaacaagtcataaccgagaacggtttgcagattatgctgcaccacccggcttagctcccgccacagcggtttcaggctgggcgcttcgacatccggtgtgcttttgcttaacggaacaatggaactgtcgctatgcgcctccagcatatccagcacctgatcccactgggtaatttccaccgggcgctgcaccggacgcgtcatcggcggtactggcggctgggctttacgttgtgcgacaaaataacccgaacgcggctgcggagtgatgagcttcatcgtctccagcgtctgatacgcctgctgcacggtgctgatactgacgccgtgctcctgacttaagctgcgcaccgacggcaatttctccccgtgacgatacagcccttgctcaatccgttcggcaagcagagtcgccagatgttgataacgcgtcatgctgtattccttatgtggaccatacagagagaaaaaccggtacagatgaggctaaaaaaccggatgcagatgctgttttaacctgtctgtatgttaaataaaagtaatatttgaatctgtattgtgaactgccagaaggtggatgatgaagcctctgaaagatgaggaggtagcagatggaatttcacgaaaacagagctaaagcgccgtttatcggcctggtgcaactctggcaggcggtgaggcgttggcggcggcaaatgcagacccgacgcgtgttacagcagatgagtgatgagcggttgaaggatatcgggttacgcagggaggatgtggagtgaggggggatatagatttatatataataaaacgtttttatgtttttaaattaagttataaaaattttcccgagacaattcatcaataggtatggagtgtacaggaatatcttcttcactaacctctttaaactcatgtcgataacggtcaaaaaacgcacagtgattacttgtgttttttgactgactttacaactctcattattcgctattgtgcagtttctctaattgttttataccctggaaagttaaatgtcagctactgaatactttttgattgtttgagatttattttcatttgaaattataaaatcaggtgataaatgagttgtgattaatagatggttgatatcatttttatctaaaattgatttatagtatcgacctgaaaaaatagttgttgccgcctgagtaactatacaatattctgaaaggttttctttcaaattagaaatgttgtggggttttgtttttgtatcttttatctctaaggagcttgctttgggtcaatcagaatacatttcatgggtaaaatgtacttcctggctaagtaactttgtgaatcttagagggttgagacaaccggatggccgtcctctttatgaatatcatgcaaccaatgatgaatatacccaattaacgcagctactccgtgcagtcggtcaatcacaatctaatatatgtaatagggactttgctgcctgttttgttcttttttgctctgagtggtaccgcagggattatgaacggcaatgcggatggacgtgggaccctatatataaaaaaatagggatttcattcaccgccacagagcttggtactatcgtaccgaaagggatggaagattactggctgcgcccaattcgattttatgaatctgaacgacgcaattttctcggaacattattcagtgaaggtggtttacctttccggctactcaaagaatcagacagtcgctttctggctgttttctccaggatccttggacaatatgagcaagcaaagcagtcaggtttttctgccctttcgctggcaagagctgtcatagaaaaatcagcgctgccaactgtttttagcgaagatacctctgtagaacttatcagtcatatggctgataacctcaattccttagtacttactcacaacctaataaatcacaaagaaccagtacaacagcttgagaaggttcaccctacctggcgaagcgagtttccaataccgttagatgatgaaacaggaacgcattttttgaatggactgctatgcgcagcctctgtagaggctaagcctcgactacaaaaaaataagagtacgcgttgccaattctattggtcagaaaagcatccagatgagcttagggtgatagtatctcttccggacgaagtttcctttcctgtaacaagcgagccgtcaactacgcgctttgaacttgccatttgtgaagatggtgaggaagtctctggccttgggccagcctatgcttctctggaaaacagacaggcaacagttcgattacgtaaaagcgaagtgagatttggcaggcaaaatccatcggcaggtttgtcgttagtggctcgtgctggagggatgattgttgggagcattaaacttgatgacagtgaaattgccattggtgaggtgccgttaaccttcatcgttgatgcagatcaatggctgttacagggacaggcttcttgcagtgtgcgaagcagcgatgttctgattgtgctccctcgggataatagcaatgttgctggttttgatggccaatcgagggcagtaaacgtattaggactaaaagcactacctgtgaagggatgtcaggacgttacagttacagcaaatgaaacttatcggattcgcaccggaagagaacaaatcagcatcggaaggtttgctctaaatggaaagcgtgcaagctgggtttgtcatccagatgaaacatttattggtgtaccaaaagtcatttctacactaccggatattcaaagcattgatgtaacgcgttacacgtgctgacaaaacagcattacagccagcaggaagtactgcgttggatcgatgtctgttcagggactcaacctaatgcaaaggatcccgcatttcttaaagtcagggcgcatatcttccagcgtaatacctagggaatatgggcttgtgttgataaagattgcagattaaagcacggtacaccgctcgacaaaggctggccctttggctatgtgtatgtgaaccagcgacaaaattgtgactgtggaagccctgtatacgaagttgcattctgtaatgattgtaatgagcctcatcttctggcacgggacaaaaagggcaaactagtccagtgggaaaataaaggtggcgatgaattctctttgcaggatgaagtacctgttgaacatgacgctacagaagaaaaagtcgaaaaagagaacagttttcagcctccgttgattattgccgcaggagagaccagcgaggcaggttataccctacaacgcctcgaccgtcagacgcgccgtattggcgttattaacaatgacagcattccgctgattattaatgatattgaacaggtttgtagtgccagtggctgtggctacagaggcatgagtgggaaacagcccttccggcgtgcactattaggtgggccattttacgttactaatatcgtgcccaccgttctagagtattgtcaggactttaccagtgatgaaggcaaagagggcgtcggaccagattcgttgccaggacgaggtcgtcgactcatcacctttacagacagtcgacaagggacagcccgaatggcggtgcgtatgcagcaagaagcagaacgcagtcgcttacgcggaagcgtagtcgaaattctcagctggcatcaaaggacgcaaacgtctacagcgccgaatgccaatgccgatctggaaaaattagcggccagggcgaagcaagcccgtgagcaggcagaagaatatcgaagctggggaatgccagaccaggcgaaattgtcacaagcacaggctgaacagcttgaacaggcttatcaggctgcaaccggtgggaaagccgcgactatcctggtatcccgaacctggacggagatggttaacgagcttaaagagagagccgatatccgcgggccggttctgcaatataaccattatcttaagcctgaagtgtttaatgaaaacggcggcccccttaagctttctgaaatgttgttgttccgggaattcatgcgtcgccctaaacggactaacagcctggaaacacaggggctggttcaggttggttaccaggggctggagaaaatacataagagccccttgcactggcaggaaaaaggattaacgctggatgactggcgcgattttctcaaggttacgttggatcattacgttcgcgagagcaacttcacacagctggatgatgagctgaaaaactggattggtagccgtttttcatcaaaattcgtccgtaacccggaatcaaaagatcctgaagataatcagaacagacgctggcctcaaattcgtaatggcaacgtatcccatcgtttagcgaagttgctgatgctgggggctggattcaaaaccgtcaatgcggcaactattgatattatcaatacatggctgaaagaagcatgggcccaacttaccggaccgcttgcagtactgaaacccgatggcaaccgtttttatttaccgaaagagcatatgactttttctttaatcacggatgcctggatttgcccggtaaccaataaaatcctggatacggcttttaaaggcttaaccccttatctgcctacccatatttcgttcgagcatcttaccctggcgcaatatgacacttttgtcgcgcagaaagtcacaatgccggaaatctggaagctggatcgttcacaggaagactacgcagagggtctggcaaaagcacgcgactgggtcagccatgatccgctgatcgcacaattgcggtcggaaaacgtctggacagacattaacgatcgtgtcgtggaaggcggcttctactatcgtactgccgagcactctgcccagcagtcgtcagaacgtctgcaaagctatgaaaagatgttcaagaatgggcaactaaatgttctcaactgttccaccaccatggaaatgggggttgataccgatcgcgtgatgacgctggcctctcgcagccagcaggcaacgattccggggccggagtggcacctgaatgacgaactggtggtgcgtagtctcggttataaaacggtagaactgaacgagtttattctgccggctaaagccaccaacgctgtcgagcgggtcaaagacattcagatccacaaacagttgaatggaccactgtcgcagtttgggcaacgcttctgggacgtgctgtttaacgaccatgaagaagcgcagtcactgatgaataacacgcgaattaccggcgttcactataccgatcgctatctgcaaaacccggttgcgctggcgttgttgggatcaattctgagaccgctaaaaacaaagctgaccgatggcgctgaagtgacgctggatacgctatttaaagataaagatcgccccggtaaccggcctttccatgactggatgagcatagcggattttcaggatttcgctgatcagtggtttgctgctgcgctgggcaggccggtagaactgacggtgttcgactcgccgcgcgatatccctcaccatcgtaaactgacggtgacttttgaggatggtcaggtattgaagatccgcttcgatcaggggatgggctactggcgcatcaacttttcatcgcaatggcattactttgatttccgcgatgacgtttctttccagttagtcaaaatggctcaggcctgcaaggaagggaatgtcgccaacagcgaagagagttgggcaacggatgtgctggtggaggtgatcgcctcctgatgatgagccgctcccgatgtggtgtcgggagcggtattttctataaaacttaccgcttatttgagatattcatcgaaaatgtcgagtaattcttgatgtatacacggccattcctgacctaaattgacggtacacaagccaatatcgaagccattaattttataacgatgtttcactgcggtatctacgtggggatatattaataacccccctatgttttcgccattttcaggctttaacgaccataagtaattcatcagttgataaagattttgcgaatgaaatttttctgttcccattcgtcgtgaaaaaatgctcttatagtatttggcgtcaacgataagtattttttctgatgagcgaatggtgatgtcagtttccattcgaggtaacaaattaagtgactgatccgatatactcgatgcatcccattttaaataagagcgggttgtgtttgcagacgttaattcacgacggcaaaattcataaagaaacttttgataaagtaatgacatctctttttcgtttctttcaaaatcatagaaacggtagtgtcctttgttttgacctggaatagaattattgacgatgaatttgcagacactgataacgaatttataataacgcgtattttttccgccattcagatagctgaaatgctgcggagttaaatgaagagtgctaatgcccggtaattttctataaagtgaacgagcttcatctctgatagttgaatttaacttttcatgcttaattaatatggctaatgtgctttttataattcggttagccagcgtgtcttcattaagcatatcaaaagtactgacggttttcccatgattaagatggaagccgcgtattgttttagcaaactctattcgccctttgatgccaggaatgatctcggtgttaggattgtaatcaagctcaagccctcggcgtgaaagctgtaaaacccctttatttaatacataccccaggatatcaagaagattgttaccgggtatggcttcaaggtttgcctgcttaatttcctgtaaataaccccatgcataggtaagcatgtaatagatattacggacaggtatcacgggctgttccactatgagtcccctaataatttgttggtccatttctgttgtttataggggtcatcaaagaaatattcttcgagtaaaggggcgatatccgtcatcacaatttcattaagccattgcgtatccggagaggtgccatcttccaacccacagcagaagtaactatgcccaatgcggaatcctttcccaaggatagtggcctctttgctgatttcctggttcaactcgttcattttttggcataaagactcaacaaatgaaggttctgcttttttattcagtaaaaaattccggaactgtggtgtatcaaaacctggctcaatatctatgaaagaaaatcgtctgcgtagggcatagtcaacaacggccagagagcgatcggcagtattcattaaaccgatgatataaacattctccgggacatagaatcgttcttcatcgttttcggagtaggttaggggaacagaccagttttcacctcgtttatcatgttccattaacatcatcacttcgccaaatactttactgagattggcacgattgatttcatctataataaaaatatactttttctctggctgctctttagcttgctgacaaaaattgtaaaatatgccgtctttacgtcggaagccgacgccattcggacgatagccctgtataaaatcctcatagctataagattgatggaactgaaccatattgacgcgttgcggagccttttctcctgtcagcaagtaagccagacggcgtgcaacaaaggtttttccaacgccgggcggcccctggaggataatattttttttgatggttaatcgtttgagtatcgtctctattgtggtttcagggataaacaaatcatttaacgcatcttccagacagtatgattcagtttttgacataggtggaataacactcttgccagaattaaatattaatttatagtcgttgattatgttgtccagcatagaggcaaatcgggtgtaatcaataccctgtgagactttttgggaacaggcgtaataggactgtccgtattttttaggatatacacccgaagttgcctgaaaatactctgcgattgttttaggtatgtctgaagagaactgccattgggcatgtggttcattcgtgtcgcttataccataagccaaaaccaactcatcaaaatctttataatagagaataacgggatatataccgttagaagcttcctgaccttctccaagaaatgcaaaccagggaatagacgtaaaattaccataaccgaaactcaattttactcgcaggttacggtaagacgttggataatctttagtggattgcgaacgttgttgctgtgcttgcttaataaatttttcaatccagggttgaatagattccataagatatgccttcctcattgctaagcctctattatcgctttcgcaacgtactgaaacaatagatttttactgcaaaatcagactggtaaatatttactgagggggaaagtttctattgagtcagtggaaggctcccggtggttaaccgggagtaaacgctgttacgcgactttctgtttaccggcaatcactccaataaacgcctgcacctgcttttgtttacgcgccgacagtttgcacacctggcgtagcgactgcatcagttcgctctcctcggcggcgggtggttgggcggtgaggacaatacagccttccatcactttgacatctaccgccgtgccagtggcaaaaccggcggcttccagccactgacctttcagggtgatggcgggaatacggctgtaatccgggtagcgactcgcataaccgacggtgacatgacggttatttgccggggagacttctgcttcgaacggttgtgcaatagaatgcgtgtcagtcataactgctattctccaggaatagtgattgtgattagcgatgcgggtgtgttggcgcacatccgcaccgcgctaaatacctgtatatatcatcagtaaatatggggaaagtccagctaaaaatagaataaaatgggcaatttctggaatgatttaaatatatttatgtgggttatgattggcgtgaaataataaaaagcgcaccggaaaggtgcgccagaaaataatgttcaggattttttacgtgaggcttttttacccccgctagctgcgcgttcagctttgattttttccagcaacgcggcggcgctgttttctccgctgatcaaatccgggttttcggcccgccactgggcggtaagttcaccacggaacgcttttgccaggatggattgcgtcaggttgttgacgcgggctaaggcgttgttgacctgtttttctatggtgtcggcgtaggcgaagagttgctcgacgcggcgaacgatttcggcttgttcttttactggaggtaataaaacaacttgggatttgatatcttttcctgaaatacctttttgaccagaagttgttttcacgcagttcatcattgcatttcgtgctgagggggatgaaaaaaatatttcgatatattctggtaaagcatctttggttaatcgagctcgaataagtttatcaggatatagcaaattttgatgttgtaattttttcaataacccacaaacaccaacaaattctaaacttccgttatagcgagtaaataaaagatctccatcttgtaatttgtggcggtttagttcactttctgaacattctagaaaccgaatatcgttttgatctacatggccagcacgtacagaactaatgcgtagtattggatgaccaacaccactttcatttggctttgatgaaagaccattacgtaattcagttaagatagattcaaaatttaacttcttaaatacagaatgttgcggctcaaaattacgccatttttctgtcaattttccattaactgcgccccccaataccgcttgacgaaaacgtttcaggatttgtgggatttgctcaaaacgtgctttggtgctgtctacctgcgccagcagcgtatcgagtttttcagcgatgattttttgttcggcaagtggtgggattggtatatttatcaaatcaaagcttgccggcttaatattattaatatttgcaccagcagaaagtgatgaaattttgtttcgataaagagaagattttgtgaaatgagcaataaaaccagaaaatataagtttttcaggacgtaatacaccgcaaaatgcgccgaaactacattcaaatggtagatgctgatgtgcggatttaccaactacggatttgctccctgatgacattgcaataacaatatcttcaggagatattttttgactttctttaacaagatttttaggaacaaaaaccaagtccgtagtatcaaacttgccattctgaatattgttcgcacggataagaggcaaataatcatcttttagataatttattgcctgctcttttttatacgttactcctcggattagagttgtgaccgtagatactggggcgataacccacccctccggcaatttccccgcactcattccttcaccccaccaaacgcttcttccagcaactgacgctgcaaatcggcctcatcgctcgcccccagttcacgcatcagcgcatccagttcagacagcgcctgtaccagttcgcccatcgcttctgccgctaatacatccggctccggcaggctgtcggcatcaatactgtctttatctttcagccaggagatatccagcgaatcggattttgcggtgcggatccactcacggctgaacttgcgccagcggctggtagcaagatgctggtcggtgtttttgttctcttcgctgtcggcaacttccgtctcttcggcgttaaaactccattcaccttcagtgcgcgggcttaaaccgtgcgggtcttcgccatacacgcgctcaaacggctgcaaatgctcgtcggtaaacggtgtgcgcttgccgaaactcggcatattggtacgcaggtcatacacccacacatcatcggtacagttcttatcctgattcgggttcgccaccgtccctttggtaaagaacagcacgttggtcttcacgccctgagcgtaaaaaataccggtcggcagacgcagaatggtgtgcagatgacacttatccatcaggtcacgacgaatgtcggtgcctttgccgccttcaaacagcacgttatccggcaccaccaccgccgcacgaccgccgggatgcagcgtttcgataatatgctgcataaagcacaactgtttgttgctggtcgggtgaacaaaggtgcgggtaatgttggtgcctgcggcgctgccaaacggcgggttagtggcgacaatatgcgccttcggcaggttttcaccgtcgctacccagagtgttgcccagacggattgcgccgccgtggtcgaggttgccttcaatatcgtgcagcaggcagttcatcagtgccagacgacgggtgccgggcaccagttcgaggccgataaacgcgcggtggatctggaaatcctgcgtgtcgccatcaaggtcgtccagatcattggtttgcgacttaacatagcggtcggcttcaatcaaaaagcccgccgtacctgccgccgggtcctgcaccacttcacgcggctgcggtttcagcagatgaataatggttttaatcagcggacgcggggtgaagtactggcctgcaccagacttggtttcattcgcgttcttctgcaacagcccttcgtacatatcgccgaagtcatcgcgcgacttaccgtgcgcgccgttgtaccagtccagcgaatccatattgctgaccagtgcggttatttgtttcggctcggtgatggtggtactaacattatgaaaaactgcctgtaccagctttttgtcatcttcgcctaaatgcacgagcatttttcggtagaactgcaactgctcctggccgatgcgggatttcaggtcatcccagcggtaaccttccggcaggtattccgcttcctgaccggtctctttacacattttcaaaaacagcagcgaggcgagttcattgacgtagttttgataggaaacgccgccatcgcgcaggttgtcgcacagcttccacagcttcgcgaccagatcgttattgttcattgtgagttccgtaaattaagcagcggcccaaattcatcgagccgcagaagaagaaattgccgagggtaatatacacaaaatcattcaggttgcatcaaggcggcaagtgagtgaatccccgggagcgtacagaagtacgtgaccggggtgaacgagcgcagccaacgcagaggcagcctgaaggatgaagtgtatacgtgtcaggccagctcgtcccagatataatcgctgaatttgcccagcagggtatcgagattatcgtcaaaggttctttgcagcatcgccttcccgccgcgacggtggaagttgccggttttgaagacatcgtcgtcgagcaccactttctctttcagcgcctgcgctaaacgatcgagccagcttaattgctcgctgctccagtcgttttcgcccttaatgcgcgtcagcgcgtgatcgacacgttcctcaaacggtttcagcgcatcgcccaccgcagcgcggcgaatatgaccaatcagccgggcggcgatatcttcattgcgcgtctctttccatgctttgcgcagggaagattcctcaaagtgctggcggtcaaaccactcctgtagctcgaccagccctttacgggtgagatcgcgcgggcgattaataactgcctgcaatgccggttgcgcgttcggggaacgttgcaccagcgagtcaaaggcttcgaggaaatcctgcggcgtgtcgtaatcaccgtacagcgattttacactcaccacttcatcgtcgatatcgaggaagatcggcgcatcattcaggttgttgatgtccgttttcagcttttccagacgggcgataaagccaggcagtttgttaaagacttcggcgctccagtgcggccctttttcccgcaggcgcgaggcgaagccgttaaagttcacgcccgccgcgtcctggcatagctcatccagacgacgcacctgtttatctatcgtttcgctgcggtcacggttaaacgtggccagaccgatgatacgctggagcttcgccaccagttgttcatggctgtgctcggcaaaactgcggccatccgcttcggtgattttataggtttctgaatcggtaatttcattgaccagcgtttgcagttccaccttcgggcgcaccaccaccggacgcatggtgtcgacgctctccagcgtgctgtagatatcgacacagtcaaaaatcttaaagctggttttattcacctccgggcataagcgcgtggcgcggcctttcatctgttcgtacagaatgcggctgcgtactttacgcaggaacacgatattacagatcgacggaatatcgacgccggtcgtcagcaggtcgacggttaccacgatattgggcagccgctctttattgaagcgggtgatcatggtctgcactttgcgcgcgtctttatcggcatcaccggtgatcttgatgatcgcgtcgtgctccagttgcggatactttttcttgaacgcggcacgcagctcttccaccaccatatcggcatgggcattggtgacgcagaagaccagcgttttttgcgatccggtcgggtcaagataattggtgagttcgttacagacggcgcggttaaacgccgggatcaccaggccacggttaaagtcggcgacttcaaaatcctgatcgtcttccagggtgtcattgatcacttctccctgcgggctgatgcgctctacctgctcgcctttggagagataaaccccctcctgcgcgttgcgggtgatgatctgaataggcggatcctggtcgatcagaaaaccgtcgataaccgcggtacggtaggtataacggtaaaccggctcgccgaaaatctgcacagtatgtagcgccggggtggcggtgagagcgatttttaccgcatcgaagtgatcgagaatgcgacggtaggcagagacgtaatccagctggctgcggaactgcagttcgccttcggtctgctctttatcgagaatatagccgcgatgcgcttcgtcaacgacgatacagtcgtaacgggccaccggcatcggttcatctgattgcagggtgcgtttcaccagcgactgtacggtggcaacgtgaattttggtgctgtcttccgggaatttatccgtcagccctttaatgtcgaaaatgctgttgaaggtgtcgccgttaatacgcgtatcttcaaacgcgcccagcgcctgttcgccaagagaacggcggtcgacaaggaagagaatgcgtttaaaacgctgggactggatcaggcggaacatcatggcgattgccgtacgggttttaccggtaccggtcgccatcgccagcaggatctcttgttgccccttgacgattgccttttcaaccgcgcggacggcatcttcctgataataacgcaggcccagctcgctcatgccagggttatcggcaaaccactgattctgtttttgcggttcgctgccgagcatttccagcagctcttccgggcggtgccactcgggtaaggctttcgacatattgcgggtatcacgcacgtcgcgataccagatgccgcttttggtcttcattgttgcgcggtattcgcgcccgttggtcgagtagcagaaggggattttaaaccgttgtttgccgctggtgtcctgccagctggtttcatactctggcactgcttcatgcacttcatccggtgagtagtgctcaagcaaggtttcccgcaggaagccattatcgaaacatttactgtagcgatacgactcattgagcctggcgggaacgtcgatattgttacgtttcgcctctaccaccgcgatgggtttgaggccgacaaacagcacataatccgcaaagccctgattacccgtttcatcttttccggtcggccattcggcaatggctttattgacgccgggttccggacgtgcgcctttggagaagcgcagggttttgctgtcggcctgccagcctgctttacgcagttgcgcatcaatcaggaagcgactctcttcttcgctaaggttgagtgtgcgcttgatggcctgatcggtaatttctttgtggtaagccttacgttcctgttcggtctgttttgccagttccgcgttcttctcggcgagctgtgcttccagtgccgcaaggcgagcctgggtttgcgcttcggtttcctgctgtttgccttccagaatggcgatatagccgttcagggcaaccagcttctgctgttgcgcttcgacttctgcctgagtctgcgctttttctcgcacctgctgttcaagctgttgttttagcgtcagcacttcctggtgatagaggttttcaccacgttccggcaacacaaacaccggcaccgggaagtcataatctttagtgaccagacggtagtaccagacagccaggcggaacccgagtcgcaggcacatctgggcatcgttgagatcgttatgatattcgtgcaccgcctggttaccaatgcggcgtaatttgtgaaatacagagaggatgttgtcatcaacaaaggcgattttgccgagttcacgcaggagatcgtgttgattctcacaaggggggatgttgagtaacagaccaagatgtttcgctgtggcttcgccaaacatacgcattttaatcagcgtcgtgttgggatcatccgggtagttattttccgccgcacaggcgatggcataagtgaagtcgttgacgcccttcaggaattcaaaattggatttattcatcattgttattaatccattgctgtgcgggcctgtccaaatatttaaggcccataacatctcatcttagctttctgtacctttccgggcaatgaccacggtcacagcaactgactcatttctaacgtgttcgtctatttttgtagtgctatagtagccgaaaaacatctacctgattctgcaaggatgtactatgacggttcctacctatgacaaatttattgaacctgttctgcgttatctggcaacaaaaccggaaggtgcagccgcgcgtgatgttcatgaggctgccgcggatgcattaggactggatgacagccagcgagcgaaagtcattaccagcggacaacttgtttataaaaatcgtgcaggctgggcgcatgaccgtttaaaacgtgccgggttgtcgcaaagtttgtcgcgtggcaaatggtgcctgactcctgcgggttttgactgggttgcgtctcatccccagccaatgacggagcaggagacgaaccatctggccttcgcttttgtgaatgtcaaacttaagtcacggccggatgccgtcgatttagatccgaaagccgactctcccgatcatgaagaacttgcaaagagcagcccggacgatcggttagatcaggcgctaaaagagcttcgtgatgcggtggctgatgaggttctggaaaacttattgcaggtttctccttcgcgctttgaagtcattgttctggatgttttgcatcgcctggggtatggcggccaccgtgatgatttgcagcgtgttggcggtactggagatggtggcatcgatggtgtgatatcgcttgataaacttggcctggagaaagtttatgttcaggcaaaacgttggcagaatactgtaggcaggccagaattacaggcattttacggcgcactggctgggcaaaaagcgaaacgtggggtgtttattaccacttctggatttacttctcaggcgcgtgactttgcccaatccgtcgagggtatggtgttggttgatggggaacgcctggtgcacttaatgatcgaaaacgaagtaggggtttcttcacgtttgttgaaggtgccgaaactggatatggactattttgagtgaaatatcaggccggatgcggctgcgccttatccggcccataaccccttacttcctcaaccccgcaaacgcagcccgaatctcttcctccggcagctggatcccgataaacaccatcgtgctatgcggtttttcatcgccccacggcctgtcccagtcggcgctgtagaggcgctggacgccctggaacagcaggcggttaggttcgccgtcaatccacagcatccctttgtaacgtagcagtttatccgccgactccagcagcaggttttccatcacgcgggaaacttcgctgatatctaccgggtaatccagttccaccacaatcgacgaaatatcgttttgtttatctgcgataaagtggaaacgcggtttggtgctgacgacgttttcttccagcataaaaccgttggtgttgaacagcaggcccagatcgatgtcgccgtgggtgacggtgtagaccggtgcgcgggcgttgatgcgcgccaggcgttcatgcagtttttctgcttcgcctgcgacgtcggttttggtcagcagaatgcggtcggcgtagccaacctgtgactgggcgatggtgaactggttcatctgctcatcggcatgtaccgcatccaccagcgcaatcacgccgtccagcagataacgctggcataaaacttcatgggagaaaaaggtctgaataatcgggccgggatcggccatgccggtgcattcaatgaccagacggtcgaactgaatattgcccttgtcgagattgtccagcaggtcgagtagcgcgtcctccagctcgttggagcgcgaacaacagatgcagccgttggtcagcgttttgatctgcgtggcgcggtcgccaatcagttgatcatcaacagagacttcgccgaattcgttttcaatcacggcaatcttgtagccgtgctgttcgttaagaatatggcgcagcagggtggtttttcctgcgcctaaaaaaccggtgagtagggtaactgcaatcgggttcatgctctctccattaacaacagcgcataccgcctttaccatcgccgccgtagcgcgcgttctggcgttcgcggaagaattcttcatagctcatgtacggcttgtcgggatggttggtcttcatatgctcgacgtagttgtcgtagtctggaatgccaatcaacatcttcgccgcctggccgagatatttttttgcctgtcctaagttaccaaacatagttcactctgataagaacaaagccccgccgaagcggggctaaacacggttagtggtgcgaagagatcttcacgccgccttccgggattggaacgtacggtgtttctttgtcagtacgtttgtcgctgttacgcaccgcaagccaggttttgaaaccgtagaagatgatgctgtacaccacaatcaggaacagaatactcagacctgcgttggtgtagttgttcacaacgatgtggttcatattggcaatctgctgcgccgtcaggtcagtaccgttagcaatcttctctttgtactggcttgccatgtagaagaagccttccatctgcgggttggtgctgaacagtttcaggcccagcgcccaggtggtgcagataagcagccatacagccggaacaacagttacccagatgtattgggtgcgcttcatcttaatcagcacaacggtgcccagtaccagcgctacggctgccagcatctggttggagataccgaacagcggccacaggctcttaacgccgcccagcggatcaaccacgccctgatacagcaggtagccccacagacccacacagcccgcagtaccgatgataccggcaaccagagaatcggtttttttcaggaacgggatgaagttacccagcaggtcttgcagcataaagcggccagaacgggtacccgcatccagcgcggtcaggatgaacagggcttcgaacagaataccgaagtgataccagaagcccatgtcagccatcggcagcactttgtggaacacgtgcgcgatacctaccgccagcgtcggcgcgccacctgcacggttcaggacagaaggctcaccaatgtctttcgcggtttgcaggatctgctctggcgaaatcacgaagccccaggagctgacggtcgctgccgcgtgtgcggtaacgtctttcagctgcgccatgatgatcggcgcgttctcgccacccatttcatgcaggttaggcatggtgatgccaaggccagcaggcggggtgttcatcgcgaagtaaagacccggttcgatgatggacgcagcaaccagcgccataatcgccacgaaggactccatcagcattgcgccgtagccgatgaaacgcgcgtcggtttcattagccagcagttttggcgtcgtaccggaagagatcagcgcgtggaagccagataccgcaccacaggcgatggtgatgaacaggaacgggaacagagcgcctttccacagcgggccagtaccgtcaatgtactgggtcatggcaggcattttcagttccgggttcagcaccacgatacccagcgccaggccgacgataacgccgattttcaggaaggttgccagatagtcgcgcggtgcgaggatcagccacactggcagcagtgcggaaacaaacgcatagccaatcagcgcgaaggtaatggtggtgtctttaaaggtcagtgccggaccccagtacggatcgtgagcaatcacgccaccgaagtagatagaggcaaccagcagcacgataccaatgacagagacttcacccacacgccccggacgaataaagcgcatgtagatacccataaacagcgcaatcggtacggttgagcaaacggtgaagacaccccacggactttcggccagggctttaaccacaatcagcgccaggacggcgaggatgatgatcatgattaagaaacagccaaacagcgcgatagtccccggtactggtcccatctcttctttgatcatctcaccaagagatgcgccattacggcgagaggagataaacagcaccataaagtcctgaaccgcaccggccagcacgacccccgccagcagccacagcgtgccaggcaggtagcccatctgcgcggcgagaaccggacccaccagcggaccagcaccggcgatagcggcgaagtggtgaccaaacaacacgtaacggttggtcggaacgtagttcagaccgtcgttgttaataaccgcaggcgtcgcgcgcgtggggtcgagtttcatcaccttctgggcgatgtacagactgtagtagcgatacgccaccagatacaccgatacagaggcgaccacgatccacagggcgctgatgtgctccccccgacgtaatgcaactaccgcgaggcagaatgcaccgatgattccgagaatcacccagggtatgtgcttgaatatctttttagtatccatagtaaaacctggcatgtattgattaatagttggccgaagccgttctaggtttgcgttgcgtttgaggaggtaaattgaccgctatcctgtagtgatgttgccagagttacgcgcgcgtaaagtaaggtaaataactgagtggttattttagggatgtaagcggtcagttttgcggttgagcggcaaaggcgtcgtttaagtgacgataaatatgtgattcatatcacatatttatattgtgaataatttatgtaaataatggctttttaaattcagagtgtgaataaaattcactcggcgtaatctccgcgggatattcataaagtttttcctttccaggccgaaaatcttgcatcggtccacaggaaagagaaaccatgttaaaacgtatcaaaattgtgaccagcttactgctggttttggccgtttttggccttttacaactgacatcaggcggtctgttctttaatgccttaaagaatgacaaagaaaatttcactgttttacaaaccattcgccagcagcaatccacgctgaatggcagctgggtcgcgttgttgcagacgcgtaacaccctcaaccgcgcgggtatccgctacatgatggatcagaataatattggtagcggttcaaccgttgctgagctgatggagagtgccagtatttcgctgaaacaggcggaaaaaaactgggcggattacgaagcgttgccgcgtgacccgcgtcagagcaccgccgcagcggcagagatcaaacgtaattacgatatttatcacaatgcgctggcggagctgatccaactgttaggtgcaggcaaaatcaacgagttctttgatcagccgacccagggatatcaggacggtttcgagaagcagtatgtggcttacatggagcaaaacgatcggctccatgatatcgccgtcagcgataacaatgcctcctacagccaggcgatgtggattctggtgggcgtgatgatcgtcgtactggcggtcatcttcgccgtctggttcggtattaaagcctcgctggtagcgccaatgaatcgcctgattgacagcattcgtcatattgcaggcggcgatctggtgaaaccgattgaggtggatggctctaatgagatggggcaactggcagagagtttgcgccatatgcagggagagctgatgcgtaccgtcggtgatgtgcgcaacggggccaatgccatctatagcggtgccagcgaaatcgccaccggcaataacgatctctcttcgcgcaccgagcaacaggccgcttcgctggaagagacggcagccagcatggagcaactgaccgcaacggtgaagcagaacgccgaaaatgcgcgccaggccagccatctggcgttaagtgcttctgaaacggcgcaacgcggcggtaaagtggtagataacgtggtgcagactatgcgcgatatctccaccagttcgcagaaaatcgccgatattatcagcgtaattgacggcattgccttccagaccaatattctggctttgaacgcggcggttgaggctgcgcgtgcgggtgagcaagggcgcggttttgcggtggtcgcgggagaagtgcgtaatctggcccagcgcagcgcccaggcggctcgtgaaattaaaagcctgattgaagactcggtggggaaagtggatgttggctctacgctggtcgaaagcgccggggaaacaatggcggagattgtcagcgccgtgacccgcgtgacggacattatgggcgaaattgcttctgcttctgatgagcagagccgtggtatcgatcaggttggcttagcggttgctgagatggaccgggtaactcaacagaacgccgcgctggtggaagagtctgccgctgccgccgccgcgctggaagagcaggccagtcgcctgaccgaagcagtggcagtgttccggattcagcaacagcagcgtgaaacatcggctgtggtaaaaaccgtgacgccagctgcgccgcgtaaaatggccgtggcagatagcgaggagaactgggaaacattttaatcgccatgaaaatgcccgataagcaaaatgttatcgggcataaggagattaatctttacgtgggtcgttgatcggctgacgaaccaggaagatgtacgccagtgcccccgctgcggtgacgcaaccgcagatgattagtgccagacggaatgagtgggtggtatcaacaataaaaccagtaatgatcggcgcaaaagaggcgcagatgaagctggcaaagttctggatactgcccaccgacgcagtcatgcgagaagcaactgcgacgtggatcaagccccagcaggatgttccggcaaagtgaatacagaacagtgccatgccaatcagcagaaccgccgtcatggatgttgtcgcttgtggtactatcagcgtaaaggcggcagaacagaacatcccggcaataatgcagatcttacggcttttaatcggagccattccccctttgaccagccagtcggtaacgtaaccgttgaccagcatcccggcagccccaaacaggaaagggatagccgccatcaaccctgtgctttttaaatccaggttataggctgtttgcaggtaaccaggaagccaggccagatacagccacgcagtgtagttgatgccactgaatccgagcatcattccccacattgtacggttacggaacaggctgcgccattcggcaaaactgagcggatctcggcgggcattgacgctacctgcattgagataagcttgctcaacggcagtcagttctacgtgctcgcggttgcgatagagcatataccagccgatggcgagaaaaatccccagtacaccaatggtaataaacatcccgcgccagcccatcaccagcatcatcgccgccagaatcggtgggcttacggcaacgccaatggtagaagctgcgttgaagaagcccatcgggcgtccgcgctctttgatgttgaaccagtcgttaatgacttttacaccgcatgggttcatcggcgcttcaccaatccccataccgatacgcaccaacacgaactgcgtaaagttgtgcaccatgccagacattgcctggaacagtgaccagaagaacatccccagtcccagcatcaggcgtgggcctttacgatccaatagtgggccgcaaggaagttgcgcaatcccgtaagcgagtgaaaacacggagagcaaagcgccgatttcggtggcacttaatcccaattcttcacgaatcgttaaatttgctaccgacagcgaactgcggtcgagataattgattaccgccgcaaaaaataataacaacatggcggtggtttgaatgcgtttaattcgggtactgcgttgaactaatccatctggtggcacgggaatatctgccgacgaagatggagtaaatgaagaacgcggatcgatggtgatattttctttttccacgccggactcctgtatttataattttaattgtttacgtaattgtgcattacgcaaggttgacattaacggcaggttaaagttttaggactttactaccgctcacaaaaacatttttagtcgactgattgtgagcataggtaagcgggaatttcccggtatttatcttttgataaaaccgtgcacccgctaatagtttgctgtttttaatccgtacttaatgagcataacgcgtgttctcattaatggatcgaatcattgattgtttagctgaattcaaatggttacggagcgcaagggtggcatcaaggtcactgcggcaaatcagagcgctgagaatggtcatatgctcatcgacggcaatgatattgcgctgtttaagatcgctttcgtcccattgatagtgaaaatgaaagatgactgagatgatctcaagcgattgatcaaaaaagatattgtcggcagctgaaagcagtaaggagtgaaaatctctgtcaagttgcgagaacatgcgaaagctattgccgatgttgtcacgcagtagccgatgacgttcgagcatggttttcgcctgcagccagcggggatcatgatcaggcaggttgagaaagtgctgaagtgaatgtgtttcgagcatttcgcgtagctcaaacagctgctcggcgtaggattgatcgaattgcttcatgctccactggccgcgcttttcgctgtgaataagattataacggccgaattttaaaagatattctcttactacaaccgggctgacacccgcggcccgagccagttgcagttcagaaaacgtttcccctgggcgtaactggcgctggtttatcatcgtgaaaaaagcctgctcaaacactttgttttgttcactcattgaagcggtagtacaggcgaaaccgtcatcatggtcaggtttacgcgcaataacatagtcgtttccaacctgcgtcaagacgccgcattcgcgtaagtggctgagaatatgacgcactgtggtgcggctgatgttgtacatttccgccagcgcactttgcgatggaagtggggaagggatatgaccccgcgccatatcatcaatgacctggttaatcacattgtggcgtaaattttgtgaacgactcatattttcctccttgtgagtccattaaaacccgatttaaaacatttttatgcgtgtgttttcacaaaaaagattttccgttccgctgccatttttcattttcattgatatctaaggcaacaaaaagtggagagccgaatcatgtctacgatgaatgttttaatttgccagcagccgaaagaattagtctggaaacaacgcgagatacctattccgggtgacaatgaagcattaataaaaattaagtctgtcgggatttgcggtaccgatattcatgcctggggtggaaatcaaccattttttagttatccacgtgttttaggccatgaaatatgtggggagattgttgggctgggtaaaaatattgctgatcttaaaaatggtcagcaagttgctgtgatcccttatgttgcctgtcagcaatgcccggcgtgtaaaagcgggcgtaccaattgctgtgaaaaaatttcagtcattggcgtgcatcaggatggcggttttagtgagtatttgagcgtgccggtggcgaacattttgcccgcagacggtattgacccgcaggcggcagcattgattgaacctttcgctattagcgctcatgcggtgcgtcgcgcagccattgctcccggcgagcaggtgctggtggtcggggcggggccaatcggtctgggcgcggcggcaatcgctaaagccgatggcgcacaggtggtggtggcggataccagtccggcgcgccgtgaacatgtggcaacgcgtctggaattacctttactggacccgtcagccgaagattttgacgcgcagctacgggcgcagtttggtggttcgctggcgcagaaagtgatcgacgcgacaggtaatcaacatgcgatgaataacaccgtgaatttgattcgtcacggcggcacggtggtatttgtcggcctgtttaaaggtgagttgcagttctccgatccggaattccataaaaaagaaacgacgatgatgggcagccgcaacgccacgccggaagattttgctaaagtcggtcgactgatggcggaaggaaaaatcactgctgacatgatgttaacccatcgctatccgttcgccacgctggcagaaacctacgagcgcgatgtgattaacaatcgtgagttaattaaaggcgtaattactttctgataaggcgagattattaaagttgccatgcagcgtccggggaagtgttgggcgctgttttttttgtttcttaataatgtgttgtaagccgtagaaggcgtgtaggtcgcaccctatgcgacctacacatcagtcaggaattacccttcacgttctaccactttaatttccaccatgccgatcccgagcttacgcggcgagtgtccgaggatattcccttcgttggttgagacaggttccggcggcacaattaccagtgtgtcggcatcggttgggttatcgaaatgcagtgtggtggtggtcacttcattgcccagcacaagagtttgttcttcattgcctacgcgtaccggaataggacggctggcgttattgccgtatgctttggcggtaatcaccaggtcaaatttcttcggcagcggatgcttgtactcgatttttacttcatcgcccagctgcgcgttggaccagcggccccacgactccggacgggaaatcccgctaaactgtttcacctcttctggcgcaccggcgacgttaaagatgaaactgtcggctttgtagcgaatatcgttatcaacaatcttcagcgtatcgacattgcctttgtaacgcgccatgtcgatgaccgtatctttaaatgccgttttgccctgccatgttgttttgtcaacatgctgaacaatttgctgaccgccaagctgcccttgcgagacacaccagtcggtggaaagtgccagttccggagcccagagttgtgccatcttgtagcaacggtcaacccagacgaaattgtcgcgtggagcgaaatcggccagctggaaacgcagcggtgctgagtattcgctttccggcagcggttccacgcgtttgtctgaaacccgcaacagcagcggcaaacggaaatggctacccgagaaggcaatcatgtttttctgctggtcgatggtgaactctttcatctctttagggaatttccacaggcggatgatatctggcttccacgccaatgttttctctttgatattgaggaagatttccgacatcgactgcccggataaactgctacgaccaagtccgagatagttatcgccaccgagaatgtccagcaccgtcgcgccgttatccatcgtgttacgcttcactgccagcgtctcttgctgcggcttgtcgccacgaatgacaaaaaacaggttattgcgatcctgcttattgaggtatttccacgccgtgttgttcatcgctaaatggtcagaagagacgacgatgacggtatctttaaaccacggtgacgctttgattttgttgataaacgtcgcgatgttctcctggctgcaacttaccgcgctgaatgactgattcggtttaccgtcaaaatcatattttttgcggttacaggtacgagagataaaaccatccgggtgatgggtatcgactgtcagggtaaacagtgagaatcgctgacctgagcgggaaagctcttcaaactttttccacgcttcatcgagaacggtatcgtcgtagaatccccagtcgttgcgatagtgcgggtcggctaccacgcttttcagctcttctgagccgtataagtggtcgaagccatgcgacttcaggaacacatctttaccggcaaaacgcagattcgcgccctgcacgaaatagttctgataacccgagtttttcaggatatctcccagacagatgttctgcgggaagaagctggagacagaggcggaggcgttgccttcaaagggggcaaacagcggtatgccgcactgagaagccaccatgcccgcaatcgtgtaatctgttcccggcagctgctgcgtgtggctgaaatccaggccttcatttttcaacgcgcccagttcaggcgtgagatccgggaaagcctcgttatcaaaataggtccgctcgagactttcgccgtagatataaaccaggttgagtttcgggtcagggatagttttcgacggctctttataataagccgcaaagtccgggtcgccgtcgcgtgactgggatttcaccagttccgttatctgacgaaatgccgggctggcgtccaccgaacccagcgccagtaagagcgccagcaggctgtaaccaaaatggtgcggatgatggcgacgacggcgcaggatccagcccagcgcaccgaacaccgctgtcagccccagcacaatgccgatacccggcaaaatgtatttgctgacgccagcaccggtcaggctgttggttaaggtatagagaaccgcgtcgttaataccatcgccagtaaaatagtcgctggcaaacagggtgatatttaaaacgacaaatagccccagcaccgttaacgtggctgcaaaccaccaggtgttacgtcccgctttccatgcgtaaatcagcacagaggcgagaaaaagggcgaaagagagtagttctgacaacgggcgatcctcactaaaccgggccgtttagccaacgtttaagctttttgagaagcacaatgtaatggcgtcgccatattgctgcaattctagtgtcaaaaaaatgcgatgttgttaggaattagtttataaacagacttttttgattacggtcacttcccgtgtaacaggggtaaaaccgtccaggagcagggaaaagggcaggagagagccgcgtcagccgggtaacagctaaaacgcggcgtttcgcggttcaggaaatgaagttcagcccctgttttaacaccagatcgcaggctttggttttcaccttttctgccagcggagttgttccgatgttatccagattgagttgctgaccatctttggttttcagcaaaccctgaatgccgtccagatagttggtgtcttctttttgctcttcactgttcaggcccagcttttccagcacctggttcttgatgttttcggcatcggttaccgacgccagcttttgcttcgcgcagtattgcagaatgcctgcggcattgttcatgttatctgcgcttaaggcctggtttccgctgctaagcaagttagttaatgacgcgagcgaccaaccgccttcctgtgtcgtgctgttttggttgccaagttcgctggcggcgctggagagcgcatctttccaggacgcagcatgcaccccggtggaaattaatgcgctggcggcaatggcacagcacagaagatgtttaacagttttcatcatcattactcaaggtggaattgtgtcgcagtataccgccagaaacggggattaatactctttacctgttacccggctacggtagctatcccagttgaagatcacccacaaactgttacccaggcgcatacggtccatcacgcgttcgcccagcaacttggtcatctcttccatattactgttggtcagcatcccggttgggcgtttggaagaagagcggcgatcgacgatctggttgatgatcactttttcgtatttcgattcggtctgcacgccgatctcatcgatcaccagcagatcaacgttgctcagatcgttaagcagttgttcttcgctggtaccgctattcctgaaggtatctttcatcgccgacataatatcggccacggtgatgatcaatacggatttaccgcgtagcagcagctcgttgcagattgccgccgccagatggtttttgccggttcctggcttaccagaaaagatgaagctggcgatgttgccgtcaaactcttcgacatactggcgcgctttgcttaacgcattcatctgcccttcacactcaacgcgatagttctcaaaggaacagttctgatgcagtggacgaataccggagcggttaaaggtgcgctgcattttcatcgcccgattttcacgttcgagagcggcggagcggatcgctccttgttctttttgccaggccagtagttcttcacccgttttgaatgcgggtttgatatgggcaggcatcattttttgcaggcgttgcatcaggtcgccaacgtttttcatcgttaccctctgaatcctggtggaatttggctgtcaggttcgctgaccgtattcacatctcgtttcggcagtccgccgttgctggcacgaccgatttgcaggctgcgcgccagtttttgttgccactgcacatggtgaaagactttaccttccgcctgccagtaggcaatgaatgaggccagttcttcggtggtcaccggctctcttagcgccacgccccatagcgccgccaggcggataaaatcggcatcgggttgccagtccggatacatggcgaatttccccatgggtacagcaacgggagcggcttgcggttcctgatagagttgatcgtccagagcgacatcgcttcccggacgcgccagcttttcttccagcgccagcagttcagccaggcgtgcaggcgtgacggcataaaacgccggggcattgttagcaaatacggcaaccacaccgccttcagcttttgccagaacggtttggtgatcgtgtaccagggcgtcaataccaacgacgtccggggtcaaaactctggaagacatactgtttctcaaatatggaacgatgaacgagaagggagataacttttatagtaacacacggaggagaggaggctgtctctcatccgtgtgcttaagcgaggcaattttatacgcgagggcgcttgcggtacaaccataatccaggaatggaaagaccgatggataacgcaccaacaatcgatgaagctgtaagaaagttggttaacagggtaatcatcaacggttcgctgtaacctaactggctgatttttaccgccgaaatcattgcggtataagccgatatgcccgggaacatagggataacggccgccacggtaaacactttcggatgcgccagataccagcgcgaccattgaataccaatggtaccgaccagcatagaagccataaaggttgaccactcaatattcaacccgctggtcatcaagatcattcgggaaccatgacctatcgagccaagcagcgcacaccagcgtaacgcccgcacgggaacgttgaacaccatcgcaaagccgaccgcaggaatggcggcgaggatcatatcctgcgccaacgctaacagaaattcgatcacacccatccgcgtagcccccaaatcgtcagtgccatcactacgccgacgcaggtagccagtgtcagcagactggcgatcgcccagcgtgccagtccggtattgatgtggcctttaaacatatcggcgacggcattaatcaacggaaagcccggcactagcagcagaacgctggcggccatcgcaatggtgggggtattgctgaaagtggggagttgcaaaagcaatccggaaatggtggtggcggcgaaagcggtaaggcaaaagttgatctgtggatgaagatgacgttgtgccagcagctggcggatatacatcgcggtcgtactggcaaagaaggtgatgacggcaccatcccagccaccgttattgagtttacagaaacaggcgcaagaaaggccaaccattaaggctaccagccatcttgggtaacgtaatggctgaatttggctaaatcgtttctctacgcctttgtaatccagcagatgatgctccgcaagaatcacaatgtgctggacttcagtcaccacatgcatattaatgccgcgatcgtgatttttacgtgtcgatgtcaggcattgcccatctttaatagttgtcagcactatggcgttcgaagagatagaactttcgacgctgtccattcccagtgcccgacccagtcgtgaggaaagctcatcaaccaacgcgctttccgcaccatgttgcaaaagaaataatccacactggatacaaagccgtgttacggctcgctgttgctcagtttgcataactcgccctttgtcatagacgtgctgcgtattgttcagataatgagaatccatttgtatcatgaagcacggttgttttgcggtaggttaagatcaaaattgcgctgattaatcctggttatcgggagaagctcggtgataaaaagcgaattatctctcgccgcaaacaaactatcacatgaatattatcatcataatgaatttattgtttggcctttacgaatcaggataatagataaccgggcacgttttttaatgttaacaagctaaaaccatcagatttcattgaataaatattggttgtgtgattttgcattctgcgggaagggatatcatttaattataaattaaatgaatgtgatttctgtttttcattaagtattcctaacaacttaatgtagatattttaaatgtctccaggctatttcaccaggttatcatttgatgctaaccttctgacacatgcagtggagttgttgtgcagcaggagtatgctgatatgaaagtgaatgctaaggataatttattcgcttaatctattaatttgctggaaacatttaaggaatgaatatcctgaataaaccatcataatttttagacagtggatgtggaggaaatatgttgccaggatgctgcaaaaatggaattgttatcagtaaaatacctgttatgcaagcagggttaaaagaggtcatgaggactcacttccctgaatatgaaataatatccagcgcctctgcggaggaccttaccttattacaattacgtcgttccggattagtcattgctgatttagccggtgaaagtgaagatccacgttctgtttgtgaacattattattctttaatctcacaatatcgggaaattcactgggttttcatggtgtcacgctcctggtattcccaggcagtagaactgctcatgtgccctacggcgacgttattgtctgatgttgaacccattgagaatctggtcaagaccgtacgttccggcaatacgcacgcagagcgtatcagcgccatgctgacctccccggcaatgactgaaactcatgattttagctatcgctccgtcattctcactctttcagagcgcaaggtactgcggctattaggtaaaggatggggcatcaaccagatagcttcattgcttaagaaaagtaataaaactatcagcgcccaaaaaaacagtgcgatgcgtcgactggcaattcacagcaacgctgaaatgtatgcatggataaatagcgcgcagggtgcaagagaacttaacttgccttctgtttatggagatgccgcagaatggaacacagccgaattaagaagagaaatgtcgcactcatagaaaaatgcgtcatgagtagtatcggtattgagagtttattcagaaagtttgcgggtaacccttataagctccatacctataccagtcaggagtcatttcaggatgccatgtcgcggatctcgtttgcggcggtcattttttctttttctgccatgagaagtgagcgcagagagggattatcttgcctgactgaactggcgattaagtttccgcgtacccggcgtttagttattgcggatgatgatattgaagctcggctgattggttcattgtcgccatcaccgctggacggtgtattaagtaaagcgtcaacgctggagatttttcatcaggaactctttttgtcattaaatggtgtacgtcaggcgaccgaccgactgaacaatcagtggtacattaaccaaagccggacgttaagcccgacggagagagaaatattgcgctttatgtcgcgtggctactcaatgacacaaattgccgagcagcttaaacgcaatatcaaaacgatccgtgcacataaatttaatgtgatgtcgaaactgggcgtcagttctgacgcagggttgttggaggccgcagatattctgttatgtatgcggcattgcgaaacaagtaatgtgttgcatccctattaatccgcatgatgccgggtttacttccccggcagtgctttcatttcagcgtacaatcgccacattgctgcacatccggtaagcgataacgctggcagcaagtgcggcgcaccagcaggccgtcgcgcagtaccacggtacgccagagtggattatcttcaccgttcgtgagcgttttctcaaaaaagagggcatggcgcagcgattcaacagtagcctcgccgagcagttgcttcatctcagtgagataccagttgatcaaataaccggtattactccagataagtttgccgttgatctctccggtcgcttctagtgcttgcacaaccggaaccagcgcctggctgattaacgtttccattcgatgctgcggcgaatgtggtgttgcgtttttatcttcacacacatcgacccagaaacaggcgacgcgtccggtttcgtgaaactcagcatggaaatgttccggcgacacatctaatgccttttcctgcgtcagtagcgccagcattaatggtggcaccatcaggccgatataccattgtgcccatagtgagatcagcggtttgttctcgcggatcatcatcggttggttgcgatagatatgatcggaatagaccgccagcagagaacttagcacattcggtgatgaccattgcgccagcgtcatggcgttaagtggggcaggttcatccaggcggataaactccagcaaatgttcacgatgttttgcgatcgtcgcccgcacggcttgcgcaagcgtgggatcctgcggctggagatgcgttcgccagatgacatcttcatagagcggtgcggaacgataggccataatcgggatagtaatctaaatgataatgattgctaatcatagcgataggtttacccgatagcaagggatttatctggcttgcaaatgataaaaattatcatatgatattggttatcattatcaatgaaagagatgaaatcatgttgcaacgtacgctgggcagtggctggggagtgttgctgccgggattgctgattgcagggctgatgtatgcggatttatcgtcagatcagtggcggattgtcattctgatgggattagtattgacgccgatgatgctgtatcacaaacagttgcggcattacattttgctaccatcgtgcctggcacttattgctggcatcatgctgatgataatgaatttgaatcagggatgaaaaatcaaggaagaaacaagaaaggaagtaaagataattggtgcgaggggggggacttgaacccccacgtccgtaaggacactaacacctgaagctagcgcgtctaccaattccgccaccttcgcacagtcatcttactttttttgatatcgcctcgtttggtgcgaggggggggacttgaacccccacgtccgtaagaacactaacacctgaagctagcgcgtctaccaattccgccaccttcgcccagtgcgagcaatatcaacgtggtttttggtgcgaggggggggacttgaacccccacgtccgtaaggacactaacacctgaagctagcgcgtctaccaattccgccaccttcgcataccatcaattcttaaaaagaattgctaccacggaggcgcattctagtggttttcagcttttcgtcaatagttaattatcgacagaggtgtaattgctggaaaaatgtccatcaggaaactagcgtgcaggtttggtatgcatgcgggggcagatgccagatgcgacgctggcgcgtcttatctggcctacgaagggctaacgtgcaggttttgtaggtcggataaggcgttcacgccgcatccgacacggtattcggcgagataattaacctttcttcgcctggcgggtcataatggcgcgatacaccttgaagcgccctgtttgcgcgatcacttcgtggaagccaaatgtctcatccagcacgtccggataaggcaggaaggcgttcgctacaattcgcagctcgccgccgctattaagatgacgcaccgcaccgcgaatcagcgtttgcgccgcatccaggctggtttgcatcccatcgtggaacggcgggttggagatgatcatatcaaaacgacctttcacctcggaaaagacgttgctggcaaagacttcaccttcaacaccgttggccgcaagtgttgcgcggctggcttctaccgccggggcagagacatcgcacaaggtgagacgaattttcggcgaatggcgcgcaaaggcaactgaaagcacgcccgcgccacagccgacatccagcactttacctttcgtgtgcggagttaacgtcgagagcagcaactggctaccgacatccagaccgtcgcggctaaacacgccaggcagcgttttgaccgtcaggccatcgacgctgtattcgccccagaatttctccgcatcaaataccggctgtttttccagacgaccaaaatagaggccacagcgacgagcgctgtcgactttattcaacggcgcataatctgccagcatctgctcggcgctgcgcacgccgctgcggttctcgccaacgacaaaaatatctgtccccactggcagcagagaaagtaaattcatcaactggaactgggcttccggtttgttcttcggccagtagtaaatcagcgtatcgcaatctgcgacgtcatccgccgtggcgaccagactgaaacgggcgttatcccccatctggcggcttaatacctgccagtggtggaattgctgggtatgagcacggctggccgcggtatctaaacgcgcgggcaggtcatcctgtaagtctccggcaaacagaatacggctttgttcgaaatcatcactgtgacgcagcaagacttcacttgccggggtaaatgcagacatggaatgctcctcaattgatactggcggcgattatagccatatgttggcgcggtatcgacgaatttgctatatttgcgcccctgacaacaggagcgattcgctatgacatcccgacgagactggcagttacagcaactgggcattacccagtggtcgctgcgtcgccctggcgcgttgcagggggagattgccattgcgatcccggcacacgtccgtctggtgatggtggcaaacgatcttcccgccctgactgatcctttagtgagcgatgttctgcgcgcattaaccgtcagccccgaccaggtgctgcaactgacgccagaaaaaatcgcgatgctgccgcaaggcagtcactgcaacagttggcggttgggtactgacgaaccgctatcactggaaggcgctcaggtggcatcaccggcgctcaccgatttacgggcaaacccaacggcacgcgccgcgttatggcaacaaatttgcacatatgaacacgatttcttccctcgaaacgactgatttaccggcggcttaccacattgaacaacgcgcccacgcctttccgtggagtgaaaaaacgtttgccagcaaccagggcgagcgttatctcaactttcagttaacgcaaaacggcaaaatggcggcgtttgcgattacgcaagtggtgctggatgaagctacattgttcaatattgcggtcgatcctgactatcagcgtcagggattgggaagggcgctgctggaacatctgatcgacgaactggaaaaacgcggcgtggcgacactatggctggaagtccgtgcttcaaacgctgccgccattgccctgtacgaaagtttaggctttaacgaggcgacgattcgccgcaattactaccccaccacggacggtcgcgaagacgccatcatcatggcgttgccaatcagtatgtaatacaaggtggaataatgaagtgggactggattttctttgatgccgatgaaacgctgtttacctttgactcattcaccggcctgcagcggatgtttcttgattacagcgtcacctttaccgctgaagattttcaggactatcaggccgttaacaagccactgtgggtggattatcaaaacggcgcgatcacttcattacagcttcagcacgggcggtttgagagctgggccgaacggctgaacgtcgagccaggtaaactcaacgaagcctttattaatgcgatggcggaaatctgcacgccgctgccgggcgcggtttctctgcttaacgccattcgtggcaacgccaaaatcggcatcatcaccaacggctttagtgccttgcaacaggtgcgtctggaacgcacgggcctgcgtgattacttcgatttgctggtgatttccgaagaagttggcgttgccaaaccgaataagaaaattttcgattatgcgctggaacaggcgggcaatcctgaccgttcacgcgtgctgatggttggcgacactgccgagtccgatattctcggtggcatcaacgccgggcttgcgacctgctggctgaatgcacaccatcgcgagcaaccagaaggcatcgcgcccacctggaccgtttcttcgttgcacgaactggagcagctcctgtgtaaacactgattgcctcccccccgttgatgggtaaaatagccgcaatttttcgttttcaacaagcgcggcgcgatgccgcttactcaagaagaaagaattatgacgttgtctccttatttgcaagaggtggcgaagcgccgcacttttgccattatttctcacccggacgccggtaagactaccatcaccgagaaggtgctgctgttcggacaggccattcagaccgccggtacagtaaaaggccgtggttccaaccagcacgctaagtcggactggatggagatggaaaagcagcgtgggatctccattactacgtctgtgatgcagtttccgtatcacgattgcctggttaacctgctcgacaccccggggcacgaagacttctcggaagatacctatcgtaccctgacggcggtggactgctgcctgatggttatcgacgccgcaaaaggtgttgaagatcgtacccgtaagctgatggaagttacccgtctgcgcgacacgccgatcctcacctttatgaacaaacttgaccgtgatatccgcgacccgatggagctgctcgatgaagttgagaacgagctgaaaatcggctgtgcgccgatcacctggccgattggctgcggcaagctgtttaaaggcgtttaccacctttataaagacgaaacctatctctatcagagcggtaaaggccacaccattcaggaagtccgcattgttaaagggctgaataacccggatctcgatgctgcggttggtgaagatctggcacagcagctgcgtgacgaactggaactggtgaaaggcgcgtctaacgagttcgacaaagagctgttccttgcgggcgaaatcactccggtattcttcggtactgcgctgggtaacttcggcgtcgatcatatgttggatggcctggtggagtgggcacctgcgccgatgccgcgtcagactgatacccgtaccgtagaagcgagcgaagataaatttaccggcttcgtatttaaaattcaggccaacatggacccgaaacaccgcgaccgcgtggcgtttatgcgtgtggtgtccggtaaatatgaaaaaggcatgaaactgcgccaggtgcgcactgcgaaagatgtggtgatctccgacgcgctgacctttatggcgggtgaccgttcgcacgttgaagaagcgtatccgggcgatatcctcggcctgcacaaccacggcaccattcagatcggcgacacctttacccagggtgagatgatgaagttcaccggtattccgaacttcgcaccagaactgttccgtcgtatccgcctgaaagatccgctgaagcaaaaacagctgctcaaagggctggtacagctttccgaagagggcgcggtgcaggtgttccgtccaatctccaacaacgatctgatcgttggtgcagttggtgtgctgcagtttgatgtggtggtagcgcgcctgaagagcgaatacaacgttgaagcagtgtatgagtcagtcaacgttgccactgcccgctgggtagaatgtgcagacgcgaagaaattcgaagagttcaagcgtaagaacgaaagccaactggcgcttgatggcggcgataacctcgcttacatcgctaccagcatggtcaacctgcgcctggcacaggaacgttatccggacgttcagttccaccagacccgcgagcattaattcttgcctccagggcgcggtagccgctgcgccctgtcaatttcccttccttattagccgcttacggaatgttcttaaaacattcacttttgcttatgttttcgctgatatcccgagcggtttcaaaattgtgatctatatttaacaaagtgatgacatttctgacggcgttaaataccgttcaatgcgtagatatcagtatctaaagccgtcgattgtcattctaccgatattaataactgattcagaggctgtaatggtcgttattcatcactcatcgcttttgtgatggcgaccattgacttctgtagagggtgaagtctctccctattcagcaatgcaacctcgtgttgccaggctcaaattacgagcaaacatacaggaataaatcgatgactatgacaagactgaagatttcgaaaactctgctggctgtaatgttgacctctgccgtcgcgaccggctctgcctacgcggaaaacaacgcgcagactaccaatgaaagcgcagggcaaaaagtcgatagctctatgaataaagtcggtaatttcatggatgacagcgccatcaccgcgaaagtgaaggcggccctggtggatcatgacaacatcaagagcaccgatatctctgtaaaaaccgatcaaaaagtcgtgaccctgagcggtttcgttgaaagccaggcccaggccgaagaggcagtgaaagtggcgaaaggcgttgaaggggtgacctctgtcagcgacaaactgcacgttcgcgacgctaaagaaggctcggtgaagggctacgcgggtgacaccgccaccaccagtgaaatcaaagccaaactgctggcggacgatatcgtcccttcccgtcatgtgaaagttgaaaccaccgacggcgtggttcagctctccggtaccgtcgattctcaggcacaaagtgaccgtgctgaaagtatcgccaaagcggtagatggtgtgaaaagcgttaaaaatgatctgaaaactaagtaattcgtcgtaattcgtcctcccgaactttgtcgggaggcgcgatgtgcaccacactaaaaatatcgcattgagtgattttcacgctcatatcaagcggtgacattaactatggtaaaggagacgcttatgtttcgttggggcatcatatttctggttatcgcgttaatcgccgccgcacttgggtttggtggtctggccggtaccgctgcaggcgcagctaaaattgtctttgtcgtcgggattattctgttcctggtgagtttgttcatgggccgaaaacgaccctagatttcagaccattaagaaaattttatccaaagccagtccagcggactggcttttgcggttttagcgaataataaattgcgttactttgtcattctttcacaacaaaaacaggaaggcagaggtggggcagcgaatacctgtaacgcttggtaatattgcgccgttgtcgctaaggccgttccagcctggacgaatagctctggtgtgcgaaggcggcggacagcgtggaattttcacggctggcgtgctggatgagtttatgcgcgcgcagtttaatcctttcgatctttatctcggcacatctgccggggcgcagaacctctcggcgtttatctgcaatcagcccggttacgcgcgcaaagtcatcatgcgctataccacaaaacgcgaatttttcgatccattgcgctttgtccgtggaggaaatcttatcgatctcgactggctggtggaggccactgcaagccagatgccgttgcaaatggataccgccgcgcggttgtttgacagcggcaaatcgttttatatgtgcgcctgtcgtcaggatgactacgcgccgaattactttttaccaaccaaacaaaactggctggatgtgattcgcgcctccagtgcgatacctggcttttatcgtagcggagtgtcgctggaaggcattaactacctggatggcgggatcagtgatgcgattccggttaaagaggcggcaaggcagggcgctaaaacgttggtcgtcattcgcactgtgccgtcacaaatgtactacacgccgcagtggttcaaacgcatggaacgctggctgggtgacagtagcctgcagccgctggtcaatctggtgcagcatcatgaaaccagctatcgtgacattcagcaatttattgagaaaccaccgggcaagctgcggatattcgaaatttatccgccgaagccattacatagtatcgcgcttggcagtcggattccggcgctgcgtgaagactataaacttgggcgtttatgcggtcgttatttcctcgccacggttggcaagctattaactgaaaaagcgccgcttacccgccatctggtgccagtggtgacgccggaatcgattgtcattccgcctgcgccagtcgccaacgatacgctggttgccgaagtgagcgacgctccgcaggcgaacgacccgacatttaacaatgaggatctggcttgatttgccgttttatcgacacccactgccattttgatttcccgccgtttagtggcgatgaagaggccagcctgcaacgcgcggcacaagcgggcgtaggcaagatcattgttccggcaacagaggcggaaaattttgcccgtgtgttggcattagcggaaaattatcaaccgctgtatgccgcattgggcttgcatcctggtatgttggaaaaacatagcgatgtgtctcttgagcagctacagcaggcgctggaaaggcgtccggcgaaggtggtggcggtgggggagatcggtctggatctctttggcgacgatccgcaatttgagaggcagcagtggttactcgacgaacaactgaaactggcgaaacgctacgatctgccggtgatcctgcattcacggcgcacgcacgacaaactggcgatgcatcttaaacgccacgatttaccgcgcactggcgtggttcacggtttttccggcagcctgcaacaggccgaacggtttgtacagctgggctacaaaattggcgtaggcggtactatcacctatccacgcgccagtaaaacccgcgatgtcatcgcaaaattaccgctggcatcgttattgctggaaaccgacgcgccggatatgccgctcaacggttttcaggggcagcctaaccgcccggagcaggctgcccgtgtgttcgccgtgctttgcgagttgcgccgggaaccggcggatgagattgcgcaagcgttgcttaataacacgtatacgttgtttaacgtgccgtaggccggataaggcgttcacgccgcatccggcagttggcgcacaatgcctgatgcgacgcttaacgcgtcttatcatgcctacaggtttgtgccgaaccgtaggccggataaggcgttcacgccgcatccggcagttggcgcacaatgcctgatgcgacgcttgtcgcgtcttatcatgcctacaagtctgtgccgaaccgtaggccggataaggcgttcacgccgcatccggcagtcggcgcataatgcctgatgcgacgcttgtcgcgtcttatcatgcctacaggtttgtgccgaaccgtaggccggataaggcgttcgcgccgcatccggcagttggcgcacaatgcctgatgcgacgcttgacgcgtcttatcaggcctacaagtctgtgccgaaccgtaggccgtatccggcatgtcacaaatagagcgccggaaatatcaaccggctcaccccgcgcacctttaacgcatcagccaacggctcaacgtcttccggcgtggcgctcgcccagctttgcgcctcgccatacacgccgtgggcatgaaacgcgttcaggcgtaccggaacatcgccgagtcccttgataaacgccgccagttcttcgatgtgttgcaaataatccacctggccagggatcaccagcaaacgcagttccgccagcttgccgcgctctgccagcaaatagatgctgcgcttaatctgctgattatcgcgtccggtgagttgttgatgacattcgctcccccacgctttgagatcgagcattgcgccgtcgcacaccgggagcaatttttcccagccggtttcgctcaacatgccgttactgtccaccagacaggtgagatggcgcagttgcggatcgtttttgatagcagtaaacagcgccaccacaaacggcagctgggtcgtggcttcaccgccactcaccgttatcccttcgataaacagcactgctttgcggacatggctaagcacttcgtccacgctcatggattgcgccatgggcgtggcatgttgcggacacctcttcaggcaggtatcacactgctcgcaaaccacagcgttccacaccactttgccgtcaacaatctgcaacgcctgatgcggacactgtggcacgcactccccacagtcattgcaacgtcccatcgtccacggattgtgacagtttttgcagcgcagattgcagccctgcaaaaacagagccagacgactgcctggcccgtcaacgcaggagaaggggataatcttactgactaaagcgcatctgctgttcatggcttatcacgcgcggctggcgttccagaatacgagtgttgcgtgcggcttcttcgcccagccaggtggtgttggtgcgtgaaccttcggcgcgatatttttctaaatccgacaaacgcaccatataaccggtaacgcgaaccagatcgttaccgctgacattggcggtaaattcacgcattccggctttaaaggcaccgaggcaaagctgtaccagtgcctgcgggttacgtttgatggtttcgtcgagcgtcagaatgtcgctgatgccggaataataataagcatgatgcggggcgacagtttgcagatgggtgatcggatctggctcatcgccatacggcaaacgcgcgcccggcgtggtgccgatatcggaactgatccccgactgtgcgtgtaacatggcgcgtttttgccagccatatttcacgggggtattggcgacaaactccgccagttgcgcgctgatgcgataacctacttcatttgcggcggcttctttaccgtagcgcgcggcaatcccttctttttcacacagcaagttaaccgcttccgccagcccatacatgccaaacattggcacaaaacgttcagggttaatcagcccttctttcaccaggaagctattctcaaagaagtgtgattgttgatagaggaattcacaccgcgcatcgatgatggcgatctgctgctggcagtagtgcggtagagtgcgcgtaaagaagtcatccagcgattcgctgcgctcggcaatggctttcaggttaaggcgtaccagcgtgctgccaccacccgccagcggcagtgagttgtaacagctcacaatcccgtagcccccttttgtgaaaattttatcatgcaccggaccgttggcgatgtgcggtttgctacattcacagatgttcttcgccacttccagcagcaggtcatcaggggtgatttcaggatcgtagataaaggtcaggttcggtgaaacctgcttcaactctgcatctgcacgtaagatcgcgcgggtaatgggcgaatcagacgggccgatattggcgtgcataaaggcgtctggcagggttctgtcgaggtaacgccagaaacgttttattcgaacatcgatctcgtcttgtgttagaattctaacatacggttgcaacaacgcatccagttgccccaggtagaccggcatcgatgtgaccgacggtacgtggtggtaaagaatggtcagcagagagagtgcgtcatcaagatctttcgcgccttccagctccagccattcggaaccgttcgccagaaaacgggcgtaatcgggtaagacatagcgcggtttgtacggcgcatgaccttcaaacatatcgcagattacaccttcatccagcgcgcggcgggcttcggcaggaagctgtgggtaaggcagattgttttctgcttccagtgccagaaaatggcgcttctgctccgggctaagcactgggctggtgacaatttgctggcaacgttgttgcagtgcattttcatgagaagtgggcatcttcttttccttttatgccgaaggtgatgcgccattgtaagaagtttcgtgatgttcactttgatcctgatgcgtttgccaccactgacgcattcatttgaaagtgaattatttgaaccagatcgcattacagtgatgcaaacttgtaagtagatttccttaattgtgatgtgtatcgaagtgtgttgcggagtagatgttagaatactaacaaactcgcaaggtgaattttattggcgacaagccaggagaatgaaatgactgatctgaaagcaagcagcctgcgtgcactgaaattgatggacctgaccaccctgaatgacgacgacaccgacgagaaagtgatcgccctgtgtcatcaggccaaaactccggtcggcaataccgccgctatctgtatctatcctcgctttatcccgattgctcgcaaaactctgaaagagcagggcaccccggaaatccgtatcgctacggtaaccaacttcccacacggtaacgacgacatcgacatcgcgctggcagaaacccgtgcggcaatcgcctacggtgctgatgaagttgacgttgtgttcccgtaccgcgcgctgatggcgggtaacgagcaggttggttttgacctggtgaaagcctgtaaagaggcttgcgcggcagcgaatgtactgctgaaagtgatcatcgaaaccggcgaactgaaagacgaagcgctgatccgtaaagcgtctgaaatctccatcaaagcgggtgcggacttcatcaaaacctctaccggtaaagtggctgtgaacgcgacgccggaaagcgcgcgcatcatgatggaagtgatccgtgatatgggcgtagaaaaaaccgttggtttcaaaccggcgggcggcgtgcgtactgcggaagatgcgcagaaatatctcgccattgcagatgaactgttcggtgctgactgggcagatgcgcgtcactaccgctttggcgcttccagcctgctggcaagcctgctgaaagcgctgggtcacggcgacggtaagagcgccagcagctactaagtaagatgctttacgcctgatgcgctgcgcttatcaggcctacgagacgtatctacccgtaggccggataaggcgtagacgcatccggcaaaagccgcctcatactcttttcctcgggaggttaccttgtttctcgcacaagaaattattcgtaaaaaacgtgatggtcatgcgctgagcgatgaagaaattcgtttctttatcaacggtattcgcgacaacactatctccgaagggcagattgccgccctcgcgatgaccattttcttccacgatatgacaatgcctgagcgtgtctcgctgaccatggcgatgcgagattcaggaaccgttctcgactggaaaagcctgcatctgaatggcccgattgttgataaacactccaccggtggcgtcggcgatgtgacttcgctgatgttggggccgatggtcgcagcctgcggcggctatattccgatgatctctggtcgcggcctcggtcatactggcggtacgctcgacaaactggaatccatccctggcttcgacattttcccggatgacaaccgtttccgcgaaattattaaagacgtcggcgtggcgattatcggtcagaccagttcactggctccggctgataaacgtttctacgcgacccgtgatattaccgcaaccgtggactccatcccgctgatcaccgcctctattctggcgaagaaacttgcggaaggtctggacgcgctggtgatggacgtgaaagtgggtagcggcgcgtttatgccgacctacgaactctctgaagcccttgccgaagcgattgttggcgtggctaacggcgctggcgtgcgcaccaccgcgctgctcaccgacatgaatcaggtactggcctccagtgcaggtaacgcggttgaagttcgtgaagcggtgcagttcctgacgggtgaatatcgtaacccgcgtctgtttgatgtcacgatggcgctgtgcgtggagatgctgatctccggcaaactggcgaaagatgacgccgaagcgcgcgcgaaattgcaggcggtgctggacaacggtaaagcggcagaagtctttggtcgtatggtagcggcacaaaaaggcccgaccgacttcgttgagaactacgcgaagtatctgccgacagcgatgctgacgaaagcagtctatgctgataccgaaggttttgtcagtgaaatggatacccgcgcgctggggatggcagtggttgcaatgggcggcggacgccgtcaggcatctgacaccatcgattacagcgtcggctttactgatatggcgcgtctgggcgaccaggtagacggtcagcgtccgctggcggttatccacgcgaaagacgaaaacaactggcaggaagcggcgaaagcggtgaaagcggcaattaaacttgccgataaagcaccggaaagcacaccaactgtctatcgccgtatcagcgaataacggtatactgatctgatcatttaaatttgaagcactgagtacggagaacatatgaaacgtgcatttattatggtgctggactcattcggcatcggcgctacagaagatgcagaacgctttggtgacgtcggggctgacaccctgggtcatatcgcagaagcttgtgccaaaggcgaagctgataacggtcgtaaaggcccgctcaatctgccaaatctgacccgtctggggctggcgaaagcacacgaaggttctaccggtttcattccggcgggaatggacggcaacgctgaagttatcggcgcgtacgcatgggcgcacgaaatgtcatccggtaaagataccccgtctggtcactgggaaattgccggtgtcccggttctgtttgagtggggatatttctccgatcacgaaaacagcttcccgcaagagctgctggataaactggtcgaacgcgctaatctgccgggttacctcggtaactgccactcttccggtacggtcattctggatcaactgggcgaagagcacatgaaaaccggcaagccgattttctatacctccgctgactccgtgttccagattgcctgccatgaagaaactttcggtctggataaactctacgaactgtgcgaaatcgcccgtgaagagctgaccaacggcggctacaatatcggtcgtgttatcgctcgtccgtttatcggcgacaaagccggtaacttccagcgtaccggtaaccgtcacgacctggctgttgagccgccagcaccgaccgtgctgcagaaactggttgatgaaaaacacggccaggtggtttctgtcggtaaaattgcggacatctacgccaactgcggtatcaccaaaaaagtgaaagcgactggcctggacgcgctgtttgacgccaccatcaaagagatgaaagaagcgggtgataacaccatcgtcttcaccaacttcgttgacttcgactcttcctggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaccggtactgaccacacgcgtgaacacattccggtactggtatatggcccgaaagtaaaaccgggctcactgggtcatcgtgaaaccttcgcggatatcggccagactctggcaaaatattttggtacttctgatatggaatatggcaaagccatgttctgatggatttgggcggagcgttgactccgcctttgttatgtcacaaaaaggataaaacaatggctaccccacacattaatgcagaaatgggcgatttcgctgacgtagttttgatgccaggcgacccgctgcgtgcgaagtatattgctgaaactttccttgaagatgcccgtgaagtgaacaacgttcgcggtatgctgggcttcaccggtacttacaaaggccgcaaaatttccgtaatgggtcacggtatgggtatcccgtcctgctccatctacaccaaagaactgatcaccgatttcggcgtgaagaaaattatccgcgtgggttcctgtggcgcagttctgccgcacgtaaaactgcgcgacgtcgttatcggtatgggtgcctgcaccgattccaaagttaaccgcatccgttttaaagaccatgactttgccgctatcgctgacttcgacatggtgcgtaacgcagtagatgcagctaaagcactgggtattgatgctcgcgtgggtaacctgttctccgctgacctgttctactctccggacggcgaaatgttcgacgtgatggaaaaatacggcattctcggcgtggaaatggaagcggctggtatctacggcgtcgctgcagaatttggcgcgaaagccctgaccatctgcaccgtatctgaccacatccgcactcacgagcagaccactgccgctgagcgtcagactaccttcaacgacatgatcaaaatcgcactggaatccgttctgctgggcgataaagagtaattgtgtttcgctgcaaggcgattgccttgtgaagccggagcgggagactgctccggctttttagtatctattcatttttctctccagcttgaatattttcgctatacttttcagtgaaatgtgttaataaatctattcaagtatctattcacgaatctattcattaatgagcgagctgactgatcttttactgcaagggccgcgttctgccccggaattgcgccagcgtctggcaatcagtcaggcgacgttctcacgccttgttgccagagaagatcgggtgattcgctttggtaaagcacgggcaacgcgatatgcactgctgcgtccttatcgcggaattgagcgtattcccgtctggcgggtggacgataccggaaaggcgcataaattcgccgacatccggttgtgctggccgcagggaagttgtctggtaacaggcgcagatggcgacgaacagtggtttgatggtttgccctggtatttgaccgatctccgaccgcagggctttttagggcgcgcgtggggcaggaagttagccgcgcaactgaatctgactgatgatatacgtctctggcaggaagaagatgtgctctacgccctgaccgtatttaacggtgaatatactggcggttggttggtcggggaggggaattatcagcgatggattactgcacaacaccctgcggaaattcctctggatcaaaaactcacccattacgaacagctggcaagtgatgcactggcaggagaaattgtgggttcttctgcgggcggcgagcagccaaaatttacctactatgcacaaacgccgtcaggcaataaacatgtgttggtgaaattcaccgtaccacagcaaaccgcggtcagccaacgttggggtgacctgctaattgctgaatctattgccgcgcaaatcctgcgtgacggtgggatccacgccatcgagtcaacggtgcttgtaacaagtaacaggcaggtattcctcgaagcggaacgctttgactgcaaaggtaacgatggtcgcttgcctattgtgtcgctggaggcggtgcagagtgagtttatctcttctccgggatcgtggccgcaggcaatgcgccgtttgtgtgagcaacaacttgtcactcaccagagcgtggcgcaaacagaagtgatctgggcatttgggcgacttatcgccaacagcgatatgcacgcaggtaatttatcgttttatttatctgaaccgccatttgcgctgacgcccgtctacgacatgctgccgatggtctatgcaccaaacagcgctggaatgctgcgtgatgctgccattgaggtgaagtttgatcttaacgtcagtaaaagcgcttggttaacggcgatcccgctggcgcagcagttctggcaaacggtcgccagagatccgcgtatcagcgaggcgtttcgccacattgcgcaagaaatgccggaaaaaatccggcaaatcgaagagaaagttgcccgcatgggcgggtaactaccttacagcccccgccatccatgccgataactcccgtagctctttttcctgttccgggaagtcaaccaacagcgcttcgcactcctgttgcagcatatctgcgcggtacaggcagccttgcagtcgtccggcgagggcttccagcggcgcggggttgaggctgtcggtaaacacctgggcgcgggtgatatggcctttttcaacgtcgaaatgcagttccacgccgccccaggtaaagcgttcatccagcagatgcgagaatgccggagcctgaccgaagttccattcccagctactctggcgggcaaaggtttcggcgaagtttggcaagtctggcgttttgttcggggagatgatttccgcttccacgcgctcgccataatgggcgaaaaaggcctcggttatggcctcgcaaacctgctcatgggtgatccccggcaacagctcggtgaggttggtcacgcgggaacgtaccgacgtaatgcctttcgccgccagtttctttttatccggattgagatagtttgccaggcggctgaggtcggcattgagtagcaaggtgccgtggtggaagccgcgatctttggtttcgcgataggccgagcctgagactttgcggtcgccttcgacggttttcaccaccagatcgttacgtccggacgcttcggcgctgacgccgagcgcgttcagcgcattgagcacaatcgacgtggagatagttttatcgtactccggcttgccagccataaaggtaaagcaggtattgccgagatcgtggaacaccgcgccgccaccgctactgcgccgcgccaggcggacgttatcttcttccatccgccgggtattacactctttccacgggttctgcgcgcgaccaattactaccgtgtcggcattgcgccagagaaacagaacgcgctgcgtggcgggcatttggcgaaaaatacactcttccaccgccaggttaaaccacgggtcgtaagagtcagagatgagcaggcgtaatgtggacataacgatttcctttcttgtagtaatgggtcactcttttttctcgctttcttcctcttccggcaccggtttgctggcggttaacaggaagggcgattgctgccagcgggtgcgtttaccctgtagcagcgtgcgggtcagcactacaccgattgccagtgagagcagcaacatcaggcgtaaaatgttagtggtgttatccacctgttgggcttcggtggcgagcgtatgggtgtcgagtgtcaggcgcagatagccgagcggtccgtttttacccgcaattggctcgacaatctgctggttaaaatagccgcctgcttttttaccgtcgagcgccagccggtcgcgcacttcgacgctttcgccagaacgtgcgataagatcgccttgttcgtcatacacacccgcgtcgaggatacggctttcatccgttaactgatcgaggatcgcctgaatgcgtttttcatccggtgagtcggtacgcatcagcggtgcaacgttcagcgtcacctgacgcgccagggtgcgggccagttcttccagctgtggattacgctgtcgctggtggttttgactaaaccatgacgctccctgcatcagcgccactaacaaggcaagacagaacaggacaatcactgcccgatgcagccggaatttcagttttgtgcgagccatcttccaccctttgaaaatttgagacttaatgttgccagaagcaatggatacaaggtagcctcatgcgttattttccctgcttcgaacgattttacaggagccttaatgcctaacattacctggtgcgacctgcctgaagatgtctctttatggccgggtctgcctctttcattaagtggtgatgaagtgatgccactggattaccacgcaggtcgtagcggctggctgctgtatggtcgtgggctggataaacaacgtctgacccaataccagagcaaactgggtgcggcgatggtgattgttgccgcctggtgcgtggaagattatcaggtgattcgtctggcaggttcactcaccgcacgggctacacgcctggcccacgaagcgcagctggatgtcgccccgctggggaaaatcccgcacctgcgcacgccgggtttgctggtgatggatatggactccaccgccatccagattgaatgtattgatgaaattgccaaactggccggaacgggcgagatggtggcggaagtaaccgaacgggcgatgcgcggcgaactcgattttaccgccagcctgcgcagccgtgtggcgacgctgaaaggcgctgacgccaatattctgcaacaggtgcgtgaaaatctgccgctgatgccaggcttaacgcaactggtgctcaagctggaaacgctgggctggaaagtggcgattgcctccggcggctttactttctttgctgaatacctgcgcgacaagctgcgcctgaccgccgtggtagccaatgaactggagatcatggacggtaaatttaccggcaatgtgatcggcgacatcgtagacgcgcagtacaaagcgaaaactctgactcgcctcgcgcaggagtatgaaatcccgctggcgcagaccgtggcgattggcgatggagccaatgacctgccgatgatcaaagcggcagggctggggattgcctaccatgccaagccaaaagtgaatgaaaaggcggaagtcaccatccgtcacgctgacctgatgggggtattctgcatcctctcaggcagcctgaatcagaagtaattgctcgcccgccatcctgcgggcggcacagcattaacgaggtacaccgtggcaaaagctccaaaacgcgcctttgtttgtaatgaatgcggggccgattatccgcgctggcaggggcagtgcagtgcctgtcatgcctggaacaccatcaccgaggtgcgtcttgctgcgtcgccaatggtggcgcgtaacgagcgtctcagcggctatgccggtagcgccggggtggcaaaagtccagaaactctccgatatcagccttgaagagctgccgcgtttttccaccggatttaaagagttcgaccgcgtactaggcggcggcgtggtgccaggaagtgccattctgattggcggtaaccctggtgcggggaaatccacgctgctactgcaaacgctgtgcaaactggcccagcagatgaaaacgctgtatgtcaccggcgaagagtcgctgcaacaggtggcaatgcgcgctcatcgccttggcctgccgactgacaatctcaatatgttgtcggaaaccagcatcgaacagatctgcctgattgccgaagaagagcaaccgaagctgatggtaattgactcgatccaggtgatgcatatggcggatgtacagtcatcgcctggtagcgtggcgcaggtgcgtgaaacggcggcttatttgacacgcttcgccaaaacgcgcggtgtggcgattgtcatggtggggcacgtaaccaaagatggttcgctggctggcccgaaagtgctggaacactgtatcgactgttcggtgcttttggatggcgatgccgactcccgttttcgcaccttgcgcagccataaaaaccgcttcggcgcggtgaatgagctgggcgtcttcgcgatgaccgaacaggggctgcgtgaagtcagcaacccttcggcaattttcttaagtcgcggcgatgaagtgacctccggtagctcagtgatggtggtatgggaaggaacgcgtccactgctggtggagattcaggcgctggtcgatcactcgatgatggcgaacccacgccgcgtggcagtggggctggaacaaaaccgtctggcaatcctgctggctgtgttgcaccgtcacggtggtctgcaaatggccgatcaggatgtgtttgtgaacgtggtcggcggcgtgaaggtaaccgaaaccagtgccgacttagcgttactgctggcgatggtttccagcctgcgcgacagaccgctgccgcaggatctggtggtgtttggtgaagtcgggctggcaggggagatccgcccggtgcccagcggtcaggaacgaatctctgaagcggcgaaacacggttttcgccgggcgattgttccggcggctaacgtgccgaaaaaagcgccggaagggatgcagatttttggcgttaaaaaactctccgacgcgcttagcgtgttcgacgacttataatgagatatacggagggagatatgtcgtcatttgattacctgaaaactgccatcaagcaacagggctgcacgctacagcaggtagctgatgccagcggtatgaccaaagggtatttaagccagttactgaatgccaaaatcaaaagccccagcgcgcaaaagctggaggcgttgcaccgttttttggggcttgagtttccccggcagaagaaaacgatcggtgtcgtattcggtaagttctacccactgcataccggacatatctaccttatccagcgcgcctgtagccaggttgacgagctgcatatcattatgggttttgacgatacccgtgaccgcgcgttgttcgaagacagtgccatgtcgcagcagccgaccgtgccggatcgtctgcgttggttattgcaaacttttaaatatcagaaaaatattcgcattcatgctttcaacgaagagggcatggagccgtatccgcacggctgggatgtgtggagcaacggcatcaaaaagtttatggctgaaaaagggatccagccggatctgatctacacctcggaagaagccgatgcgccacagtatatggaacatctggggatcgagacggtgctggtcgatccgaaacgtacctttatgagtatcagcggtgcgcagatccgcgaaaacccgttccgctactgggaatatattcctaccgaagtgaagccgttttttgtgcgtaccgtggcgatccttggcggcgagtcgagcggtaaatccaccctggtaaacaaacttgccaatatcttcaacaccaccagtgcgtgggaatatggccgcgattatgtcttttcacacctcggcggtgatgagatcgcattgcagtattctgactacgataaaatcgcgctgggccacgctcaatacattgattttgcggtgaaatatgccaataaagtggcatttatcgataccgattttgtcaccactcaggcgttctgcaaaaagtacgaagggcgggaacatccgttcgtgcaggcgctgattgatgaataccgtttcgatctggtgatcctgctggagaacaacacgccgtgggtggcggatggtttacgcagcctcggcagttcggtggatcgcaaagagttccagaacttgctggtggagatgctcgaagagaacaatatcgaatttgtgcgggttgaagaggaagattacgacagtcgtttcctgcgctgcgtggaactggtgcgggagatgatgggggagcagagataaccgtgatgaaactgctcaaaggcgaggtataaaatgagtttttttgatgagttgaaaacctctctggaagaggctgtcgagattaaacaaggtttgaaaaaacctgcacgggtgacccgccacgaaattgaggatgctaaggctgttgtagaccggaaacggtgttcacgccgcatccggcattcggtgctcaatgcctgatgcgacgcttaccgcgtcttatcaggcctacagttttacaacgtattgaaattgctggttttgtaggccggataaggcgttcgcgccgcatccggcattttacgcattacttcgcaatacgcttgtacttgatacgcttcggctccagcgcgtctgcgcccagcgtgcgtttcttgtactcttcgtactcggtaaagttaccttcgaagaactcaactttaccttcatcctggtaatccagaatgtgcgtggcgatacggtcgaggaaccaacggtcgtgcgagataaccatcgcacagcccgggaactccagcagggcgttttccagcgcgcgcagggtttcgatatccaggtcgttggttggttcgtcgagcagcagcatgttgccgccaacctgcagcagcttcgccagatgcagacgaccgcgctcaccaccggagagttcaccaacgcgtttaccctgatcaacccctttaaagttaaagcggccaacgtaggcgcggcttggcatctcggtgttgccgatcttcatgatatccagcccgccggaaacttcttcccaaacggttttgctgttatccattgagtcacggaactgatcaaccgacgccagtttcaccgtttcacccaaagtgatggtgccgctgtccggctgttcctgaccagagatcatacggaacagggtcgatttacccgcaccgttcggaccgatgatcccgacgatcgctcctttcgggatcgagaagctcaggtcatcaatcagcagacgatcgccataggatttacgcaggttgctgacttccagcactttatcgcccagacgcggtccaggtggaataaacagttcgttggtttcgttacgtttctgatattcggtgctgttcagttcttcaaagcgcgccagacgtgctttacctttcgactgacggcctttagtaccttgacgtacccattccagctctttctcaatcgacttacgacgcgccgcttcttgtgaagcttcctgcgccaggcgctgatctttctgctccagccaggaggagtagttaccttcccacggaataccttcaccgcggtcaagttcgaggatccagcctgcaacgttatcgaggaagtaacggtcgtgggtaatcgccacaacggtgccttcgaagtcgtgcaggaagcgttccagccaggccacggattcggcatccaggtggttggtcggttcgtcgagcagcagcatgtctggtttttccagcagcaggcggcacaacgctacgcgacgacgttcaccaccggagaggttagcgattttcgcgtcccagtccggcagacgtagcgcatccgccgcacgctccagctgtacgttcagattatgaccgtcgtgagcctgaatgatctcttccagacggccttgttcagcggccagcttgtcaaaatcggcatccggatcggcgtacagcgcatacacttcatccaggcgtttcagggcgttaaccacttctgaaaccgcttcttcaatggactcacgcacggtgtgttccgggttcagctgcggttcctgcggcagataaccaatcttgatgtctggctgcggacgcgcttcaccttcgatgtctttatcaatgcccgccataatgcgcagcagggtggacttacccgcgccattcagacccaggacaccaatttttgccccagggaagaaactcagagagatgtttttcaaaatatgacgtttcggcggaacaactttgccgacacgatgcatggtataaacgaattgagccacgttggacttcgcctctatgtttatcgtgataatgagttttcaaaggcgaagtgtagcctttttccccgcctaatcccagccggtcgatcaccctcgcagtaaaagtaaaaaagtgtccgtaacgtggcgtaaacggcaatgactggttagcataaatctattacgcggcatgacgctgcattgatgtatttacacttagaggatgcgcttgtggaaaaagccaaacaagttacctggcggctgttggctgccggtgtctgtctgctgacggtcagcagcgtggcgcgagccgactcactggatgagcagcgtagtcgttacgcgcaaatcaagcaggcctgggataatcgacaaatggatgtggtcgaacaaatgatgcctggactgaaggattatccgctttatccctacctggaataccgccagatcaccgatgatctgatgaatcaaccggcggtgacggtcactaactttgttcgcgctaaccccacgcttcctcccgctcgcacgctgcaatctcgtttcgtcaatgaactggcgcggcgtgaagactggcgtggcttgttagcctttagcccggaaaagcccggaactaccgaagcgcaatgtaattactactatgcgaaatggaacaccgggcagagtgaagaagcctggcaaggggcgaaagagctgtggctaaccggcaagagccagcctaacgcctgtgacaagttatttagcgtctggcgtgcgtcaggtaaacaagatccgctggcgtatttagagcgtatccgtctggcgatgaaagcgggtaacacaggcctggtaacagtgctggcagggcagatgcctgccgattaccagactatcgcctcggcaatcatttcactggcgaacaaccctaatacggtactgaccttcgcgcgtacaactggcgcgaccgattttacccgtcaaatggcggcggtggcgtttgccagtgtggcgcggcaggatgctgagaatgcacggctgatgatcccatcgcttgcccaggcgcagcagcttaatgaagatcagattcaggagctgcgcgatatcgtcgcctggcgtttgatgggcaacgatgtcaccgacgagcaggcgaaatggcgcgatgacgccattatgcgctcgcaatctacttcgcttattgaacgccgtgtacgaatggcgcttggcaccggcgatcgtcgcggcctgaatacctggctggcgcgtctgcctatggaagcgaaagagaaagatgaatggcgttactggcaggcggatttattgctggaacgcggacgtgaagctgaagcaaaagagattttgcatcaactcatgcaacagcgtggtttctacccgatggttgcagcacaacgcatcggcgaagagtatgagctgaagattgataaagcgccgcagaatgttgacagcgccctgactcaggggccggagatggcgcgcgtgcgcgagttgatgtactggaatctcgataataccgcgcgtagcgagtgggccaatctggtgaagagcaagtcaaaaacagagcaggctcaactggcgcggtatgctttcaacaaccaatggtgggatcttagcgttcaggcaacgatcgccgggaagctgtgggatcatctggaagagcgattcccgctggcttacaacgatcttttcaaacgctacaccagcggtaaggagatcccgcaaagctatgcgatggcgattgctcgtcaggagagcgcctggaatccgaaagtgaaatcaccggtaggggccagcggcttgatgcagattatgcctggtacagcgacccatacggtgaagatgttctctattcccggttatagcagtcctgggcaattgctggatccggaaacgaatatcaacattggcaccagttacctgcaatatgtttatcagcagtttggcaataatcgtattttctcctcagcagcttataacgccggaccagggcgggtgcgaacctggcttggcaacagcgccgggcgtatcgacgcagtggcatttgtcgagagtattccattctccgagacgcgcggttatgtgaagaacgtgctggcttatgacgcttactaccgctatttcatgggggataaaccgacgttgatgagcgccacggaatggggacgtcgttactgatccgcacgtttatgatatgctatcgtactctttagcgagtacaaccgggggaggcattttgcttcccccgctaacaatggcgacatattatggcccaacaatcaccctattcagcagcgatggcagaacagcgtcaccaggagtggttacgttttgtcgacctgcttaagaatgcctaccaaaacgatctccatttaccgttgttaaacctgatgctgacgccagatgagcgcgaagcgttggggactcgcgtgcgtattgtcgaagagctgttgcgcggcgaaatgagccagcgtgagttaaaaaatgaactcggcgcaggcatcgcgacgattacgcgtggatctaacagcctgaaagccgcgcccgtcgagctgcgccagtggctggaagaggtgttgctgaaaagcgattgattttgtaggcctgataagacgtggcgcatcaggcatcgtgcaccgaatgccggatgcggcgtgaacgccttatccgtcctacaaatacccgtaatttcaatatgtttggtaggcatgataagacgcggcagcgtcgcatcaggcgcttaatacacggcattatgaaacggactcagcgccaggatcaccgcctggtgatagacgctggcgcgagtgagtttcccggcggtaaacacgccgatcgccccttccttacgaccaatctcatcaataccggtataacgcgacatcacgggaccaagcgcctcaccttcacgcactttttccagaatcaccgcaggcaacggcaaagtagccgaacgcgcctcgccgcgctggctggcgttttcaatcaccacccaactgaaagtgctgtcaccatcgatgccagcttcaatcgccacccaaaaatcagcctctggaagtaaacggcgggcattggctacccgatttcgtgcgccagcgcgcgtttcctcactgccaaagggctgttccggtacaccgctctcgacggcaacggatgcaatatggcaggatccttcgccgaagatctcgtgaaatgcctgcagaatggcctgaattttagcgggattggtggtcgcacagacaacttggtgcataatcagcattactcagaaaattaacgttacagcagtatacggaaaaaaagcatgttacaggtatacctagtccgccacggtgaaacgcagtggaacgccgagcgacgtattcagggccagtctgacagcccgctgaccgccaaaggtgagcaacaggcgatgcaggtggcaacccgtgccaaagagcttggcattacgcatatcatcagtagcgatttaggacgcacccggcgtacggcggaaatcatcgcccaggcctgcggctgtgacatcatctttgattctcgcctgcgtgaattaaacatgggtgtgctggaaaaaagacatatcgattctctgaccgaagaagaagagaactggcgtcggcagctggtcaatggcaccgttgacgggcgtattcctgaaggcgagtcaatgcaggagctcagcgatcgcgtcaatgcggcactggaatcttgccgggacttaccgcagggaagccgaccgctgctggtgagtcatggtattgcactgggatgcctggtgagtacgattctcggattaccagcatgggcagagcgccgcttacgtctgcgtaactgttctatttcgcgcgtggattatcaggaaagcctgtggctggcgtctggctgggtcgttgaaaccgcaggggacatctcgcatctggacgcccctgcattagatgagctgcagcgttaacgacggatcggaatcagcagttcacagcgtagattaattgggcgatctcccgctttggcatcttctgccgggtagtatcgctcaatatcctgacctttacggcgcgtcaggttgagcattggcatgcacgttccgtataccgtcaggataaactcctgcacgccggttcccagaccttcataggtaaacatcacatattcgccgccctgcagcatcaccggatgccccgtcagtacatagccatctgcctgatcctgggctaacgcggtggtatagaatacctcttgctcgtcgtctttatcctgactcggacgcgtttcattcaggccgtagagcaccggcggaatggtcggcgcgttgccgagaaaatcgtgccagaactgataacgcatttcatggcggaaatcagagatttgctccagcgaacaggagtagctctgggtaacaccaatcagcggcgtatcttccagggtgacaaatttgtgctctggcatagtgaattcacccaggcgtagcggcgggcgaataccaaaggcgctccattcaggagaacggcggtaaagtgcaggagtctgggcaaactgcttcttgaatgcgcgggtaaatgtctgttgagagtcgaagcggtattgcagcgcgatgtccagaatcggacgcgcagtcaggcgtagtgcgaccgccgatttcgacaaacgacgagcacgaatatacgcgccaatagcatggccagtgacatctttaaacattctctgtaagtgccacttggaataacctgctttcgccgctacattgtcgagcgacaggggctgatccagatgaccttccagccagattaaaaggtcgcgaataatgccggcctgatccataaaatatcctcatcctttcaacaacgagcacctgacatcaggtaattggataatagcattttttgctgttttagcattcagtgtttttttcttagtagagtatgttttagggcttgacggaaataaaagtattgagattttgttcttaatcaatatgttatttaccgtgacgaactaattgctcgtgtaatagataaaaatggtaacaatatgaaatacaagcatttgatcctgtctttaagcctgataatgctggggccattggctcatgcagaagagattggttcggtcgacaccgtatttaaaatgatcggcccggatcacaaaattgttgtggaagcctttgatgatcccgatgtgaaaaatgtcacctgttatgtgagccgggcgaaaaccggtggtattaaagggggattgggtctggcggaagatacctccgatgcggccatttcttgtcagcaagtcgggccgattgaactgtcggatcgtattaaaaacggcaaagctcagggcgaggtagtattcaaaaaacgcacgtccctggtctttaagtcgttacaggtcgtgcgcttttatgatgccaaacgcaacgcgctcgcttatctggcttactccgacaaagttgtagaaggttcgccgaaaaacgcgattagcgcggttcctgtcatgccgtggcggcaataacagaggcgatttatgcaacgggaaacggtctggttagtggaagatgagcaagggatagccgacacgctggtctacatgttgcagcaggaaggttttgccgtcgaggtctttgagcgaggcttgccggtgctggataaagctcgcaagcaggtacccgacgtcatgattctcgatgttggtctgccggatattagcggctttgaattgtgccgccagttactggcgctccatccggcgttacctgtactgttcctgacggcccgaagtgaagaggtcgatcgcctgcttgggctggaaattggtgctgacgactacgtggctaaaccgttttcaccccgcgaagtgtgcgccagggtgcgcaccttactgcgtcgggtgaagaagttctcgacgccgtctcccgtcatccgtattggacattttgaattgaatgaacccgcggcgcagatcagctggtttgacacgccattagcgctgactcggtatgagtttttattgttgaagacgttactcaagtcaccgggccgcgtctggtcccgccagcaactgatggatagcgtatgggaagatgcgcaggacacctacgatcgcaccgtcgatacccacattaaaacgctgcgtgccaagctgcgcgccatcaaccccgatctttcaccgattaatactcatcgcggcatgggatatagcctgaggggcctgtaatgcgtatcggcatgcggttgttgctgggctattttttactggtggcggtggcagcctggttcgtactggccatttttgtcaaagaagttaaaccgggcgtgcgaagagcaacggaggggacgttgatcgacaccgcaacgttgctggcggagctggcgcgtcccgatttgctctctggggacccaacgcatgggcaactggcgcaggcgtttaatcagctacaacatcgcccgtttcgcgccaatatcggtggcattaacaaagtgcgcaatgaatatcatgtctatatgaccgatgcgcagggcaaagtattgttcgattcggcaaataaagccgttggacaggattattcgcgctggaatgacgtctggctaacgttgcgtggtcagtatggtgcgcgcagcacgttgcaaaatcctgccgatcccgaaagttctgtgatgtatgttgccgcaccgattatggacggctcgcggcttattggcgttttgagcgtaggcaaaccgaacgcggcgatggctccggtcattaagcgtagcgagcggcgaattttatgggccagcgccattttgttggggattgcactggtgattggcgcaggcatggtttggtggatcaaccgctctattgcccggctcactcgctatgctgattccgtcactgacaataagcccgttcctctccccgatctcggtagtagcgagttgcgtaaactcgcgcaggcgctggaaagtatgcgcgtgaagctggaagggaaaaactatattgagcagtatgtttacgcattaactcatgagctaaaaagcccactggcggcgattcgtggagcggcggaaattttacgcgaaggtccgccgccggaagtggtggctcgttttactgacaacattctgacgcaaaatgcgcgtatgcaggcattggtagaaacgttactacgccaggcaagactggagaatcgtcaggaagtcgttctgactgctgttgatgtggcggcattattccgccgcgtcagcgaagcgcgcaccgtgcagttggcagaaaaaaaaatcactctgcatgttacgcccaccgaggttaacgttgctgctgaaccggcgttactggagcaggcgctgggaaatttactggataacgccatcgattttacccccgagagcggttgcatcacgctaagcgccgaagtggatcaggaacacgtcacgcttaaggtgctggataccggtagtggtattcctgactacgcgctttcacgtatttttgaacgcttttactctttgcctcgtgcaaatgggcaaaaaagcagcggtctggggttggcgttcgtcagtgaggtcgcccgtttgtttaacggcgaagtcacgctgcgcaacgtgcaggaaggtggcgtgctggcctcgcttcgacttcaccgtcacttcacatagcttcaaattcttcccacatagtcttcgtatcctgctgccattgcaaaggagaagactatgttgaaatcccccctgttctggaaaatgactagcctgtttggtgcagtattgctgttgttgattccgataatgctgattcggcaggtgattgtcgaacgtgctgattaccgtagcgatgtggaagatgcgattcgccaaagtaccagcgggccgcaaaaactcgttgggccgctcatcgctattcctgtgaccgagctttatacggtgcaggaagaggataaaaccgtggagcggaaacgaagttttatccatttttggttacctgagtcattgatggttgatggcaatcagaacgtggaagaacgcaagatagggatttataccggtcaggtctggcacagtgatttaacgttaaaagccgatttcgatgtttcgcgtcttagcgaactcaacgcgccaaatatcaccttaggcaagccatttattgtgattagcgtcggggatgcgcgtggtattggtgtggtgaaagcgcctgaagttaacggaacggcgctgaccattgaacccggcaccgggttagagcaaggcgggcagggcgtgcatatccctttacctgaaggggactggcggaagcagaacctgaagctgaatatggccctgaatttaagcggtaccggcgatctttctgtggtgcctggcgggcgtaatagcgaaatgaccttaaccagcaactggccgcatcccagttttttaggtgattttctaccagccaaacgggaagttagcgagtcaggttttcaggcgcactggcaaagcagctggtttgctaataatctcggtgagcgttttgcttcaggcaatgataccggctgggaaaacttcccggcgtttagcgtcgcagtaacgacgccagccgatcaataccaattaactgaccgggcgactaagtacgccattctgctgattgcactgacttttatggcgttctttgtttttgaaacgctcaccgcgcaacgtttacacccaatgcaatatttgctggtggggctttcattggtgatgttttatttgctcttgctggcgctttctgaacataccggttttaccgtggcatggataatcgccagtctgattggggcgataatgaacggtatttatttgcaagcggtattgaaaggttggtgcaacagcatgttgtttaccctcgcgctgttgttgctggatggtgtgatgtggggactgctcaactctgccgatagcgcgctgttgttgggaaccagtgtgctggtggtggcgctggccggcatgatgtttgtgacccgtaatatcgactggtatgcgttttcactgccgaaaatgaaagccagtaaagaagttacaacggacgatgagttacgtatctggaaataaggttgaaaaataaaaacggcgctaaaaagcgccgttttttttgacggtggtaaagccgattaatcttccagatcaccgcagaagcgataaccttcaccgtgaatggtggcgatgatttccggcgtatccggcgtagattcgaaatgtttacgaatacggcggatcgtcacgtctacagtacggtcgtgcggtttcagctcacggccggtcattttcttcagcagttcagcacgggactgaattttgcctgggttttcacagaagtgaagcatggcgcggaactcgctgcgcggcagcttgtactgctcgccatcagggccgatcaacgaacggctgttgatgtccagttcccaaccattgaacttgtagctttcaacgctacgacgttcttcgctgacagtacccagattcatggtacgggacagtaggttgcgtgcacgaatcgtcagttcacgcgggttgaacggtttggtgatgtagtcatctgcaccgatttcgaggccgagaattttatcgacttcgttgtcacggccagtcaggaacatcaacgcaacattcgcctgctcgcgcagttcacgcgctaacagaagaccgttcttacccggcagattgatatccatgatcaccaggttgatgtcatattcagagaggatctgatgcatttccgcgccatctgtcgcttcgaaaacatcatagccttccgcttcgaaaatacttttcaacgtgttgcgtgttaccaactcgtcttcaacgataagaatgtgcggggtctgcatgtttgctacctaaattgccaactaaatcgaaacaggaagtacaaaagtccctgacctgcctgatgcatgctgcaaattaacatgatcggcgtaacatgactaaagtacgtaattgcgttcttgatgcactttccatcaacgtcaacaacatcattagcttggtcgtgggtactttccctcaggacccgacagtgtcaaaaacggctgtcatcctaaccattttaacagcaacataacaggctaagaggggccggacacccaataaaactacgcttcgttgacatatatcaagttcaattgtagcacgttaacagtttgatgaaatcatcgtatctaaatgctagctttcgtcacattattttaataatccaactagttgcatcatacaactaataaacgtggtgaatccaattgtcgagatttattttttataaaattatcctaagtaaacagaaggatatgtagcattttttaacaactcaaccgttagtacagtcaggaaatagtttagccttttttaagctaagtaaagggctttttctgcgacttacgttaagaatttgtaaattcgcaccgcgtaataagttgacagtgatcacccggttcgcggttatttgatcaagaagagtggcaatatgcgtataacgattattctggtcgcacccgccagagcagaaaatattggggcagcggcgcgggcaatgaaaacgatggggtttagcgatctgcggattgtcgatagtcaggcacacctggagccagccacccgctgggtcgcacatggatctggtgatattattgataatattaaagttttcccgacattggctgaatcgttacacgatgtcgatttcactgtcgccaccactgcgcgcagtcgggcgaaatatcattactacgccacgccagttgaactggtgccgctgttagaggaaaaatcttcatggatgagccatgccgcgctggtgtttggtcgcgaagattccgggttgactaacgaagagttagcgttggctgacgttcttactggtgtgccgatggtggcggattatccttcgctcaatctggggcaggcggtgatggtctattgctatcaattagcaacattaatacaacaaccggcgaaaagtgatgcaacggcagaccaacatcaactgcaagctttacgcgaacgagccatgacattgctgacgactctggcagtggcagatgacataaaactggtcgactggttacaacaacgcctggggcttttagagcaacgagacacggcaatgttgcaccgtttgctgcatgatattgaaaaaaatatcaccaaataaaaaacgccttagtaagtatttttc
